United States Patent 9,364,528 (COMBINATION NEISSERIAL COMPOSITIONS) - sequence listing, part 3

SEQ ID NO: 8185 - protein, 1082 aa, Neisseria meningitidis
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPPNLHTGDFPNPNDAYKNLINLKPAIEAGYTGRGVEVGIVDTGESVGSISFPELYGRKEHGYNENYKNYTAYMRKEAPEDGGGKDIEASFDDEAVIETEAKPTDIRHVKEIGHIDLVSHIIGGRSVDGRPAGGIAPDATLHIMNTNDETKNEMMVAAIRNAWVKLGERGVRIVNNSFGTTSRAGTADLFQIANSEEQYRQALLDYSGGDKTDEGIRLMQQSDYGNLSYHIRNKNMLFIFSTGNDAQAQPNTYALLPFYEKDAQKGIITVAGVDRSGEKFKREMYGEPGTEPLEYGSNHCGITAMWCLSAPYEASVRFTRTNPIQIAGTSFSAPIVTGTAALLLQKYPWMSNDNLRTTLLTTAQDIGAVGVDSKFGWGLLDAGKAMNGPASFPFGDFTADTKGTSDIAYSFRNDISGTGGLIKKGGSQLQLHGNNTYTGKTIIEGGSLVLYGNNKSDMRVETKGALIYNGAASGGSLNSDGIVYLADTDQSGANETVHIKGSLQLDGKGTLYTRLGKLLKVDGTAIIGGKLYMSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 8186 - protein, 593 aa, Neisseria meningitidis
MPYFALFDDAVSGRAKRYQNHVESRFFRPEELDALDGALQSGWQKGLHSVLFADYGFGLPLTGVESERGGNLALHWFANCADIDAESWLARHSDGLPAGISTPQPSVSETDYLDRIRQIHEAIRRGDTYQINYTTRLHLQAYGNPVSLYRRLRQPVPYAVLSHLPDAEGQSAWTLCFSPELFLKIGSDGTISTEPMKGTAPILGDGQDERRAAELQADPKNRAENVMIVDLLRNDLGKIAQTGTVCVPEPFKVSRFGSVWQMTSTIQAQALPHTSFADILRAAFPCGSITGAPKKMSMQIIESLEAEARGLYTGSIGYLNPCSGGLGFEGTFNVVIRTLSLTPLSDGIYQGVYGVGSGIVIDSDPAAEYRECGWKARFLNELRPDFGIFETLRAENGRCTLLDRHLCRLKTSAQALNLPLPDGCENQIKQYIADLPDGAFRVKALLASDGISLSRAVLNRLTDKQRVIISPAVLPAQNYLRRFKTTCRALFDQAWQTAETQGAFDSLFFNSDGILLEGGRSNVFIKHRGQWLTPSLDLDILNGIMRQAVLDEPQKYLQTNQVIETHITQKTLQEAEEIRLSNALRGVFAAALA

SEQ ID NO: 8187 - protein, 505 aa, Neisseria meningitidis; identical to SEQ ID NO: 3854

SEQ ID NO: 8188 - protein, 544 aa, Neisseria meningitidis
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVDELKNIAKPCDTSKEIAQVGSISANSDEQVGAIIAEAMEKVGKEGVITVEDGKSLENELDVVEGMQFDRGYLSPYFINDAEKQIAALDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQAKRIEIGKENTTIIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIEMGVLDPAKVTRSALQHAASIAGLMLTTDCMIAEIPEDKPAVPDMGGMGGMGGMM

SEQ ID NO: 8189 - protein, 96 aa, Neisseria meningitidis
MTIRPLHDRVVVKRLEAEEKTASGIVLPGAAAEKPDMGEVIAVGAGKIGKDGSRRPLDVKVGDKIIFGKYSGQTVKADGEELLVMREEDIFGIVEK

SEQ ID NO: 8190 - skipped

SEQ ID NO: 8191 - protein, 511 aa, Neisseria meningitidis
MSDSKTKERATFGTRRAFMIAAIGSAVGLGNIWRFPYIAFENGGGAFILPYLVALLTAGIPLLLLDYAIGHRYRGSAPLAFRRLGRWFEPVGWWNVMTNIVICIYYAVIIGWAASYTYYSVNAAWGADPQGFFFKDFLQMAGPEALGLDFVGKVAGPLAGVWVFTAAIMALGVQKGVARASSFFMPLLLVMFLIMVGISLTLPGAAKGLDALFTPDWSKLADSKVWVAAYGQIFFSLSICFGIMVTYSSYLKKKTDLGGTGLVVGFANSSFELLAGIGVFAALGFMAQAGGKAVNEVASGGIGLAFIAFPTIINQAPMGWLIGILFFGSLVFAGVTSMISILEVIVAAIQDKLNIGRVNATLLVCIPMGIVSTLLFGTATGLPVLDVMDKFVNTYGIVAAGFVYVAAIIISGRLPELRKHLNALSSIRIGGLWTVCVVVTVVMLGYMLFKDTSGLMEKNYEGYPDGFLSIFGWGMSAALVVFGLLLSLLPWKHGQDFNVKDEHEHEQGEEK

SEQ ID NO: 8192 - protein, 414 aa, Neisseria meningitidis
MTLFCEQVPYPRLAEAFGTPLYVYSQSALTEAFEHYQTAFAALNPLVCYAVKANGNLSIIKHFASLGSGFDIVSGGELARVLAAGGDAAKTIFSGVGKSEAEIEFALNAGVKCFNMESIPEIDRIQKVAARLGKTAPVSLRINPDVDAKTHPYISTGLKANKFGIAYADALEAYHYAAQQPNLKIIGIDCHIGSQLTDLSPLVEACERILILVDALAAEGIVLEHLDLGGGVGIVYQDENVPDLGAYAQAVQKLIGTRRLKLILEPGRSLVGNAGSLLTRVEFVKYGEEKNFVMVDAAMNDLMRPALYDAYHHIEAVETKDIATLTANIVGPICETGDFLGKDRTIACEEGDLLLIRSAGAYGASMASNYNARNRAAEVLVDGNEYRLIRRRETLEQQMANELACLQAEHQNAV

SEQ ID NO: 8193 - protein, 56 aa, Neisseria meningitidis
MKYGVFFAAATALLLSACGYKGDLYLPKEGDKARFGVIQTGLQLQSKPQSAPQTQK

SEQ ID NO: 8194 - protein, 107 aa, Neisseria meningitidis
MMTESEFIRASEALFEHIEDQIDENGWDFDCRFAGNVLTIEAGDGAQIIVNRHTPNQELWIAAKSGGYHFAEQNGKWLATRDGRDFYDVLNEALSAASGEAVEIAEL

SEQ ID NO: 8195 - protein, 338 aa, Neisseria meningitidis
MNTRPFYFGLIFIAIIAILANYLGNTDFSHHYHISALIIAILLGMAIGNTIYPQFSTQVEKGVLFAKGALLRTGIVLYGFRLTFGDIADVGLNAVVTDAIMLISTFFFTALLGIRYLKMDKQLVYLTGAGCSICGAAAVMAAEPVTKAESHKVSVAIAVVVIFGTLAIFTYPLFYTWSQHLINAHQFGIYVGSSVHEVAQVYAIGENIDPIVANTAVISKMIRVMMLAPFLLMLSWLLTRSNGVSENTSHKITIPWFAVLFIGVAIFNSFDLLPKELVKLFVEIDSFLLISSMAALGLTTQASAIKKAGLKPFVLGILTYLWLVVGGFLVNYGISKLI

SEQ ID NO: 8196 - protein, 139 aa, Neisseria meningitidis
MAQLPLYLTSEIKDFTVGTPKVLESFSKHIPYGVVFEDDGDTGYFYAASQDGILDALHIYNVEDVSDKHIPNHVLILWDDACTIAALCINDYIHAVYDFVEQAGYCRNGFPEAGGEWVKVENRVLDDELLDKILSRKST

SEQ ID NO: 8197 - protein, 168 aa, Neisseria meningitidis
MPLLDSFKVDHTRMHAPAVRVAKTMTTPKGDTITVFDLRFCVPNKEILPGKGIHTLEHLFAGFMRDHLNGNGVEIIDISPMGCRTGFYMSLIGTPSEQQVADAWLASMQDVLNVKDQSKIPELNEYQCGTYQMHSLAEAQQIAQNVLARKVAVNKNEELTLDEGLLNA

SEQ ID NO: 8198 - protein, 938 aa, Neisseria meningitidis
MSNRPTLLLVDGSSYLYRAYHAMGQNLTAPDGAPTGALYGVLNMLRRLRSEYPHDYCAVVFDAKGKNFRHQMFEEYKATRPPMPDDLRPQAEALPDLVRLTGWPVLVIGQVEADDVIGTLAKQGAEHGLRVIVSTGDKDMAQLVDERVTLVNTMSSETLDIEGVKAKFGVRPDQIRDYLALMGDKVDNVPGVEKCGPKTAVKWLEAYGSLAGVMEHASEIKGKVGENLQAALPQLPLSYDLVTIKTDVDLHAELSDGIESLRRTTPKWAQLVVDFKRWGFRTWLKEAESNMNTGSTDDLFGSDSIGEQAALNAEMPFEKQAEKATAPEKLDYQAVTTEAQFAALLDKLSRADTIGIDTETTSLDAMNASLVGISIAFQAGEAVYIPVGHSLTAAPEQLDLQDVLGRLKPHLGNPALKKIGQNLKYDQHVFANYGIALNGIAGDAMLASYIIESHLGHGLDELSERWLGLETITYESLCGKGAKQIGFADVAIGQATEYAAQDADFALRLEAHLRAQMDEKQLEMYEKMELPVAQVLFEMERNGVQIDRAELARQSAELGAELMKLEQEAYAAAGQPFNLNSPKQLQEILFDKMGIPTKGLKKTAKGGISTNEAVLEQLAPDYPLPKIILQNRSLAKLKSTYTDKLPEMISPKDGRVHTTYAQAVAITGRLASNNPNLQNIPIRTEEGRKVRRAFTAPQGSVIVSADYSQIELRIMAHLSGDKTLIAAFQNGEDVHRRTAAEVFGTAPENVSSEQRRYAKSINFGLIYGMGQYGLAKSLGIDNLSAKNFIDRYFARYPGVAEYMQRTKEQAAAQGYVETLFGRRLYLPDIRNKNANARAGAERAAINAPMQGTASDLIKRAMIDVSRWLSECEASPWDELLQSKLIMQVHDELVLEVVETELDFVKEKLPQIMAKVDGGLLDVPLVAEVGVGENWEEAH

SEQ ID NO: 8199 - protein, 223 aa, Neisseria meningitidis
MFPDKYKLSLKENIFLAKKVLVAQIHNLSRFENCQTTLLQTEQIIHGKNVASASLEDIQTILNLKRAYQYVISHISNGEPVDISLLKKINNIVAKDDSLAPGDFRTGSVGVTLLDGSRHAPNPVKEIEVARVLQNIGLQSGSTTEAAVRFMLYCMRQQVFWDGNKRTATLFANGLMMAGGCGILEISEMQMPQFNEKLSAFYRSGDDTDISKFVYQNCISGID

SEQ ID NO: 8200 - skipped

SEQ ID NO: 8201 - protein, 1457 aa, Neisseria meningitidis; identical to SEQ ID NO: 650

SEQ ID NO: 8202 - protein, 143 aa, Neisseria meningitidis
MTENAQDKARQAVETVVKSPELVEQILSDEYVQIMIARCFHSGPLPPPSDLAQYNDIISNGADRIMAMAEKEQAVRHETIRQDQTFNRRGQLYGFISAILILLFAVFLVWSGYPATAASLAGGTVFALAGAFVIGRSRDQGKN

SEQ ID NO: 8203 - protein, 448 aa, Neisseria meningitidis
MSDNVPTIAAVATAPGRGGVGVIRISGKNLLPMAQALCGKTPKPRTATYADFTDTDGQAIDSGLLLFFAAPASFTGEDVIELQGHGGPVVMDMLLNRCLELGARLAEPGEFTKRAFLNDKLDLAQAEGVADLIDASSRSAARLALRSLKGDFSRRIHGLVEDLITLRMLVEATLDFPEEDIDFLEAADARGKLDGLRRAVDDVLANAQQGAILREGLNVVLVGAPNVGKSSLLNALAGDEVAIVTDIAGTTRDAVRERILIDGVPVHIVDTAGLRETDDVVERIGIERSRKAVSEADVALVLVDPREGLNEKTRAILDALPPELKRIEIHSKSDLHAHAAGGFGTGAETVIALSAKTGDGLDALKRTLLREAGWQGESEGLFLARTRHVNALKAAQEELSLAALCGNHQIELFAEHLRLAQVACGEITGEFTADDLLGVIFSRFCIGK

SEQ ID NO: 8204 - protein, 714 aa, Neisseria meningitidis
MNTPLFRLSLLSLTLAAGFAHAAENNAKVVLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIITKTVDAQDLLKGLDKNWGVRLNSGFASNEGVSYGASVFGKEGNFDGLFSYNRNNEKDYEAGKGFRNNFNGGKTVPYSALDKRSYLAKIGTSFGDGDHRIVLSHMKDQHRGIRTVREEFTVGGDKERISMERQAPAYRETTQSNTNLAYTGKNLGFVEKLDANAYVLEKERYSADDSGTGYAGNVKGPNHTQITTRGMNFNFDSRLAEQTLLKYGINYRHQEIKPQAFLNSQFKIEDKEKATDEEKNKNRENEKIAKAYRLTNPTKTDTGAYIEAIHEIDGFTLTGGLRYDRFKVKTHDGKTVSSNNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHSQRWTNTLPGVGRDVRLGVNYKF

SEQ ID NO: 8205 - protein, 321 aa, Neisseria meningitidis; identical to SEQ ID NO: 902

SEQ ID NO: 8206 - protein, 322 aa, Neisseria meningitidis; identical to SEQ ID NO: 3006

SEQ ID NO: 8207 - protein, 324 aa, Neisseria meningitidis; identical to SEQ ID NO: 2964

SEQ ID NO: 8208 - protein, 208 aa, Neisseria meningitidis
MTQEHFPSFFNQAPTITVQDALAEFLGAAENGILTYRYADAVRLCGHSCPTVAGAYLMVIKGLKALYGEELPERGGIEAFMQGARDEGTVGVTASVVQLLTGAAPETGFGGIGMQGRFARRHLLSFGVGEINGTLTLRRKDNGKTVAVGLNAALQPFAPEMRDIMPKAVSGSASAEELERFGQLWQARVKAFLTESADDPQFVIVREV

SEQ ID NO: 8209 - protein, 252 aa, Neisseria meningitidis
MITIRNVSYRIGTRPILDNVSLDIPEGGITALVGPNGAGKSTLFSFMARLRPLESGSIAYRGKNLADTPTAELAKTLSILTQENSIMSRITVRDLLMFGRYPYHQGRPTAECRRIVNGAIEEFHLQDLSDRYLTELSGGQRQRAMIAMVFCQSTDYVLLDEPLNNLDMYHARSLMQILRRLTDEHKRTTVVVLHDINQAAAYADHVVAMKNGQVAMQGKPNDIFTAANIKTLFDMDVDVLDYEGKKLVIHHI

SEQ ID NO: 8210 - protein, 364 aa, Neisseria meningitidis
MSMKHFPSKVLTTAILATFCSGALAATSDDDVKKAATVAIVAAYNNGQEINGFKAGETIYDIGEDGTITQKDATAADVEADDFKGLGLKKVVTNLTKTVNENKQNVDAKVKAAESEIEKLTTKLADTDAALADTDAALDETTNALNKLGENITTFAEETKTNIVKIDEKLEAVADTVDKHAEAFNDIADSLDETNTKADEAVKTANEAKQTAEETKQNVDAKVKAAETAAGKAEAAAGTANTAADKAEAVAAKVTDIKADIATNKADIAKNSARIDSLDKNVANLRKETRQGLAEQAALSGLFQPYNVGRFNVTAAVGGYKSESAVAIGTGFRFTENFAAKAGVAVGTSSGSSAAYHVGVNYEW

SEQ ID NO: 8211 - protein, 112 aa, Neisseria meningitidis
MKKIEAIVKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 8212 - protein, 1320 aa, Neisseria meningitidis
MSVVLPLRGVTALSDFRVEKLLQKAAALGLPEVKLSSEFWYFVGSEKALDAATVEKLQALLAAQSVEQTPKAREGLHLFLVTPRLGTISPWASKATNIAENCGLAGIERIERGMAVWLEGRLNDEQKQQWAALLHDRMTESVLPDFQTASKLFHHLESETFSGVDVLGGGKEALVKANTEMGLALSADEIDYLVENYQALQRNPSDVELMMFAQANSEHCRHKIFNADFILNGEKQPKSLFGMIRDTHNAHPEGTVVAYKDNSSVIEGAKIERFYPNAAENQGYRFHEEDTHIIMKVETHNHPTAIAPFAGAATGAGGEIRDEGATGKGSRPKAGLTGFTVSNLNIPDLKQPWEQDYGKPEHISSPLDIMIEGPIGGAAFNNEFGRPNLLGYFRTFEEKFDGQVRGYHKPIMIAGGLGSIQAQQTHKDEIPEGALLIQLGGPGMLIGLGGGAASSMDTGTNDASLDFNSVQRGNPEIERRAQEVIDRCWQLGGKNPIISIHDVGAGGLSNAFPELVNDARRGAVFKLREVPLEEHGLNPLQIWCNESQERYVLSILEKDLDAFRAICERERCPFAVVGTATDDGHLKVRDDLFANNPVDLPLNVLLGKLPKTTRTDKTVAPSKKPFHAGDIDITEAAYRVLRLPAVAAKNFLITIGDRSVGGLTHRDQMVGKYQTPVADCAVTMMGFNTYRGEAMSMGEKPTVALFDAPASGRMCVGEAITNIAAVNIGDIGNIKLSANWMAACGNEGEDEKLYRTVEAVSKACQALDLSIPVGKDSLSMKTVWQDGEEKKSVVSPLSLIISAFAPVKDVRKTVTPELKNVEDSVLLFVDLGFGKARMGGSAFGQVYNNMSGDAPDLDDTGRLKAFYSVIQQLVAENKLLAYHDRSDGGLFAVLVEMAFAGRCGLDIDLNLLLAQTFITNHTALSQSLRTEEVKALAEWQETIARTLFNEELGAVIQVRKQDVADIINLFYQQQLHHNVFEIGTLTDENTLIIRDGQTHLISDNLIKLQQTWQETSHQIQRLRDNPACADSEFALIGDNERSALFADVKFDVNEDIAAPFINSGAKPKIAILREQGVNGQIEMAAAFTRAGFDAYDVHMSDLMAGRIHLADFKMLAACGGFSYGDVLGAGEGWAKSILFHPALRDQFAAFFADPDTLTLGVCNGCQMVSNLAEIIPGTAGWPKFKRNLSEQFEARLSMVHVPKSASLILNEMQGSSLPVVVSHGEGRADFALHGGNISADLGIALQYIDGQNQVTQTYPLNPNGSPQGIAGVTNADGRITIMMPHPERVYRAAQMSWKPEGWTELSGWYRLFAGARKALG

SEQ ID NO: 8213 - protein, 252 aa, Neisseria meningitidis
MKITPVKALTDNYIWMIQHGNHAVCVDPSEPSPVLEFLVRNRLMLAQTWVTHPHPDHEGGAAALWRGYMESPVYGESDIEAATHTVTAGTQFTFGDGQVTVWATPGHTDRHTSYLLETSDGIHVFCGDTLFSAGCGRVFTGTIEQLYDSFQRFNRLPENTLFYPAHEYTAANLRFAAHIEPDNADIQTALKAAAHTPTLPVTLAHERRVNPFLRVDLPHVRDRAEALSGKTLNSSLDTFVALRELKNQYRTK

SEQ ID NO: 8214 - protein, 1431 aa, Neisseria meningitidis; identical to SEQ ID NO: 3584

SEQ ID NO: 8215 - protein, 484 aa, Neisseria meningitidis
MSIEPTPPNLENDGIENDVERVSADFDRVHSLCEILEPAFEQIENGTPLEDAPLRDKLTELTVLLSELHPADVAAVLESLPPRERNIVWILVKPEDDGEVLLEVSDAVRETLIESMDKDELLAAVDDLDADELAELADDLPHQVVYEALQTRDEEERAQVKAAMSYEDNQVGAIMDFELVSIRADVACEVVLRYLRRFDSLPDHTDKIFVVDENDVLQGVLPIRKLLVADPEDLVENVMAKDVVRFRAEDDVEEAAQAFERYDLVTAPVVDENKKLIGRITIDEMVDVIREESEADMLNMAGLQEEEDLFAPVWDSVKNRWMWLAVNLCTAFLASRVIGAFEGSIEKIVALAALMPIVAGIGGNSGNQTITMIVRAMAMGQLTDMQAGRLLKKEVGVALVNGIIWGTVMGAVSWLLYGSLGIGLVMIAAMTLNLLLAATVGVLIPVVMEKFGRDPALGSSVLITAVTDSGGFLIFLGLATLFLL

SEQ ID NO: 8216 - protein, 302 aa, Neisseria meningitidis
MNQTAINRADVRTRFIFDDMPVRGLHVRLENVWQHIVKQKNYPAAIRRALGELLAAGVLLSGNLKNEGTLIVQVQGRGRLKMLVAEAASDRTVRATARWDETAEIADDESLGDLLGEGGVFVLTLQPKDGEPWQGVVPLEGGGIAQMLVNYMKRSEQLDTHIVLSASDEAAGGLLVQRLPEEVLDEEAWEHVSTLARTLTAEELAGLDAQHVLYRLFHETPPRVFEPETFEFSCTCSRGKVSDMLLMLGGEEVGGVVVEQGSIEVDCDFCHSKYVFDETDVNALFGEDVVGVAKGLPRHTVQ

SEQ ID NO: 8217 - protein, 251 aa, Neisseria meningitidis; identical to SEQ ID NO: 1784

SEQ ID NO: 8218 - protein, 72 aa, Neisseria meningitidis
MSMPEMPKWYDDDGQIVSCTEKVKVMSENMAELYQTAQDAFEDALLMGCGERQLRDYLLALIEGLENPYRKV

SEQ ID NO: 8219 - protein, 115 aa, Neisseria meningitidis
MNIIRALLIILGCLATGETAVFLAGIKLPGSIVGMGVLFALLQAGWVKTSWLQQLTDALMSNLTLFLVPPCVAVISYLDLIADDWFSILVSASASTLCVLLVTGKVHRWIRGIIR

SEQ ID NO: 8220 - protein, 230 aa, Neisseria meningitidis; identical to SEQ ID NO: 1790

SEQ ID NO: 8221 - protein, 406 aa, Neisseria meningitidis
MAVNLTEKTAEQLPDIDGIALYTAQAGVKKPGHTDLTLIAVAAGSTVGAVFTTNRFCAAPVHIAKSHLFDEDGVRALVINTGNANAGTGAQGRIDALAVCAAAARQIGCKPNQVLPFSTGVILEPLPADKIIAALPKMQPAFWNEAARAIMTTDTVPKAASREGKVGDKHTVRATGIAKGSGMIHPNMATMLGFIATDAKVSQPVLQLMTQEIADETFNTITVDGDTSTNDSFVIIATGKNSQSEIDNIADPRYAQLKELLCSLALELAQAIVRDGEGATKFITVRVENAKTRDEARQAAYAVARSPLVKTAFFASDPNLGRLLAAIGYAGVADLDTDLVEMYLDDILVAEHGGRAASYTEAQGQAVMSKAEITVRIKLHRGQAAATVYTCDLSHGYVSINADYRS

SEQ ID NO: 8222 - protein, 469 aa, Neisseria meningitidis
MTSTFPRRLARKIRQTRRLSRKSIAFLFLLAGSALVALTALFFAHLADFALELNAKLVQQYPWFAWVALPLGLPLIAWLTRKFAPFTAGSGIPQVIASLSLPYGAQKTRLIRLGQTLLKIPLTFLGMLFGASIGREGPSVQVGAAVMGAWGAWCKKHGLAFKGMQENDLMAAGAAGGLAAAFNAPLAGVIFAIEELGRGIMLRWERQILLGVLASGFIQVAIQGNNPYFSGFNGGVLEHIFLWVALSGLVCGAAGGLFGRLLYRGAAAFAPRKIRGFIRNRPLLLAALMGLLLALLGTFYQGKTYGTGYHEAAQALHGIYEAPFGLAAAKWLATVFSYWAGVPGGIFTPSLTIGAVLGEHIAAIADISQGANIIVLICMAAFLAGATQSPITSAVVVMEMTGGQSLLFWMLIACIFASQVSRQFSPRPFYHASGMRFRQRVLQETAAQTGNAPARPQTANSKTGMPSEN

SEQ ID NO: 8223 - protein, 463 aa, Neisseria meningitidis
MFPDFSQTLSKDRHFLRSAFKNPNKYGGLSKIEEKYRKSHEIFLKRLAALPKPEFDNTLPVHEKLEEIKKAIAKNQVTIICGETGSGKTTQLPKICLELGRGAAGLIGHTQPRRLAARSVAERIAEELKSEIGSAVGYKVRFTDHTSRDACVKLMTDGILLAETQTDRYLAAYDTIIIDEAHERSLNIDFLLGYLKQLLPRRPDLKVIITSATIDAERFSRHFNGAPVLEVSGRTYPVEILYRPLTGKDEDDAEVELTDAIVDAADELARHGEGDILVFLPGEREIRETAEALRKSTLRRNDEILPLFARLSHAEQHKIFHPSGAKRRIVLATNVAETSLTVPGIKYVIDTGLARVKRYSARAKVEQLHIEKISQAAARQRSGRCGRVSAGVCIRLFSEEDFNSRPEFTDPEIVRSNLAAVILRMAALKLGDVAAFPFLEMPDSRYINDGFQVLLELGAVEAV

SEQ ID NO: 8224 - protein, 547 aa, Neisseria meningitidis
MDEIQIPKKVELQTKLENEKIVLSKGSTTIIVGANGTGKTRLAVYIEEQLKEKAHRISAHRALKLNPNVNKIPEKSAKTYLSYGQNWDGIDVSNRKNYRWDNNSYTHLLNDFDWLLQYLFAQQNNIAVANNQKLNRNEKVTNSKTKLDILQEAWETLLPHRKLHITADDIQVSAVDNEELYSASNMSDGERALFYILGQVLSVDDGSVLIFDEPELHIHKSIISNLWDKIEELRPDCSFLIITHDIEFAATRVAKKYVIRNYYPTPAWDISEVPESNFDEETITMILGSRKPILFVEGNNNSLDIATYRYCYPDWTIIPKGACKDVIQSVSSLKKLSNEMPLLNLKCSGIVDLDSRDEREIEQLNNLGIYILPVSEIENLFSLTDVAKEILKLNQYSDEELLNKLNGFKSELIKYIDNELKDDKLDEFVVKQVRRKIDNYLKNIDLSSKITSTDMKKSLLNEISTLTEQKIETWISEIKNEIQRCIEQQDLDKLLTIYDNKGLLAKSACVLKGMRNKHEFESWIMRTLKGRNKDFIDAIRQKLPILD

SEQ ID NO: 8225 - protein, 60 aa, Neisseria meningitidis
MKNHQTTLSFPTSSSLKPCADKQGLSEDRSQYRLTKLGEQMAHLPIDPKIARILLVLFRF

SEQ ID NO: 8226 - protein, 525 aa, Neisseria meningitidis
MMKKSFLTLVLYSSLLTASEIAYRFVFGIETLPAAKIAETFALTFVIAALYLFARYKVTRLLIAVFFAFSIIANNVHYAVYQSWMTGINYWLMLKEVTEVGSAGASMLDKLWLPVLWGVLEVMLFCSLAKFRRKTHFSADILFAFLMLMIFVRSFDTKQEHGISPKPTYSRIKANYFSFGYFVGRVLPYQLFDLSRIPAFKQPAPSKIGQGSVQNIVLIMGESESAAHLKLFGYGRETSPFLTRLSQADFKPIVKQSYSAGFMTAVSLPSFFNAIPHANGLEQISGGDTNMFRLAKEQGYETYFYSAQAENEMAILNLIGKKWIDHLIQPTQLGYGNGDNMPDEKLLPLFDKINLQQGKHFIVLHQRGSHAPYGALLQPQDKVFGEADIVDKYDNTIHKTDQMIQTVFEQLQKQPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 8227 - protein, 1139 aa, Neisseria meningitidis
MQNMKNQVRGSGMDARSNPANVSDGLQNSSGHIGTNTRYRLTKLGEQIARLPIDPKIARILLAAKKHDCMAEILVIASALSIQDPRERPLEARDASAKAHERFTDKQSDFLAYLNIWDSFQRERDKGLSNKQLVQWCRQYFLSHLRMREWRELHHQLAQTAIEMGLTTKEAAFRRPPEVRQLTSSENAGDQDLSAKLKQKQLDKKQHRAQIRAAKEAGYEQIHRALLTGLIANVGMKSPDGNDYTGARGSRFHLFPASALFKAKPKWVMAAELVETTRLYARDVAVIQPEWIEQEAPHLVRYHYFEPHWEQKRGEVVASERVTLYGLTVLPRRPVSYGKVAPEEAREIFIRSALVAQECDLKADFFVHNKKLIKEITELEHKSRKQDVLVDDEALFAFYNERLPEMAWKDAQGSVWGSEDSVRIIESDKAERSSENERNEFRKNKRNGSRQNENHGNTVGWVENPTSAATAKTVGFDNPTYAAQQTTPSPVGEGRGEGKTVAAQTNFSATAANPLPNPLPQEREQSAAASTISDDLRPANLQQTAPSPVGEGWGEGKTVATQTNFSATSTNPLPQEREQSASASTFSDDLRPANLQQPSPSPVGEGWGEGKTVATQTNFSATSTLSDDSKPKKQPAPQKNRLKPLPLADIRTFQAWLKTAERDNPRLLFLSRDDLMQHAAAHITEEQFPKFWQTADGKFKLSYRFEPHHPLDGVTMTVPLTVLNRLHAPSLEWLVPGMIREKIQLQIKALPKQIRRICVPVPEFITQFLSQNPDRNAPILPQLAQAIAKTAGDIRIFEQINQDEWAAFRLPEHCYFNLRIIDDGGQELAGGRKLHELQQQLGQAAAVTFRDNTQEFERDNVTAWDIGTLPESIKFARGKQQLTGYLGLQKEKDGRIALRLFDTTEAAEQAHRQGVIELMKLQLKEQVKDLNKGIQGFTQAAMLLKHINADTLRDDLTQAVCDRAFIGEDELPRNEKAFKEQIKRARSRLPAVKEALSRYLQETAAVYAELNSKLGKHPLTHLLRLRLQTLLAAGFATRTPWAQWPRLPIYLKAMTLRLEKYSSNPARDAAREADIQELEQMWQEKTDSLIKQGLPISDGLAAFKWMIEELRVSLFAQELKTPYPVSVKRLLKEWEKIEK

SEQ ID NO: 8228 - protein, 363 aa, Neisseria meningitidis
MQTFNRERLEFALDKRGCTQTKLAELLGITARQVRNYVKDEQIPDLNELANLLEFPVHFFTNDERLPELKSQAVSFRARSRTSKRLEKQALNHSITAFLLNDWLETEFTLSQAVLPDFSDISPEEAAQELRLEWGLGNEPIPNMITLLEVKGVRVFSLSLDTKDIDAFCTWYENHPFVFLNTQKSAERSRFDAAHELGHLIRDKYSMEHSKNSEITEDEPRDIIEKEANAFASAFLMPEAALRLYRHVPITIENLLKIKRRFGVSLVALAYRMHKLGMITDRMYIHNLCPLFAKKKYRTIEPEPMEREISSALRKMLTILKNDGIGIEQIAENLNVSPKDVADLTFGLVERDLNRYRKLRLVK

SEQ ID NO: 8229 - protein, 214 aa, Neisseria meningitidis
MVEFALSEPFPFEVGEIVEQQNSDIALSEISKYLSQEMLKEIVLTAHNNIQDKAALSDRNTLGMYRQAEITFALRVYLSKDGWTLEPWSGGAFLCLSPCRTKSIIVATATSDVGRHHGMPMTTARKGKGFEEAIRNSKLDLPDTVQFWVLLFHWKYNKVQLELSLPSGFVSHQITGYKQRIILADVDLTKFDELERKQPVEEYEPLVERKQKAG

SEQ ID NO: 8230 - protein, 82 aa, Neisseria meningitidis
MRSLLVRAMFGERMVGRFVLQSGKRSSENRVQTTFWFSWEGLWFKKTACVCTAHTLHTDSKFCVICRSGVPKDKDTVGQATY

SEQ ID NO: 8231 - protein, 89 aa, Neisseria meningitidis
MSNVHPYTIFATMPHKSTAKDILIMSYDLSKRLVIGLASSALFDLSESDNIFRMEGAETYRQYQREKQNHPLKKALSFHLLKNFCQSMK

SEQ ID NO: 8232 - protein, 149 aa, Neisseria meningitidis; identical to SEQ ID NO: 822

SEQ ID NO: 8233 - protein, 148 aa, Neisseria meningitidis
MSVMAGRHPYGVRSGLRRNGLKLWDIHFRMTRFIVARCGLLFATLKGKTMKKMFVLFCMLFSCAFSLAAVNINAASQQELEALPGIGPAKAKAIAEYRAQNGAFKSVDDLTKVKGIGPAVLAKLKDQASVGAPAPKGPAKPAIPAAKK

SEQ ID NO: 8234 - protein, 220 aa, Neisseria meningitidis
MDMLEILFRHQDFVAINKPGGISVHQDSGETGLARTLAIQLGVERVWLLHRLDKQTSGILLFALNKESASALSGQFAGKSIKKTYLALSDRKPSKKQGWIKGGMEKSRCGMWKLTRNTENIAVTRFHSISIAEKLRLFILEPHTGKTHQLRVAMKSLGSPILGDSLYGGTESETMFLYAWKIQFDYQNRQIEIVAPLKNEWQTENIHRALEEFCMENKID

SEQ ID NO: 8235 - protein, 170 aa, Neisseria meningitidis
MLPNTPRRAVYAGSFDPPTLGHLWMIRQAQSMFDELIVAIGINPDKRSTYTVAERQDMLCDITKMFPNVRTDVFENRFLVHYAREVDAGFIVRGIRSASDYEYERSMRHINSDLAPEISTVFLMPPREIAEVSSTMVKGLVGPEGWTETIHRYVPQAVYEKILAEHQHEN

SEQ ID NO: 8236 - protein, 227 aa, Neisseria meningitidis
MQHDVYDYTAHTVSKNTVLQKTYRLLGFSFIPASAGAALAANAGFNFYAAFGSRWIGFAVVLAFFYGMIHFIEKNRYSNTGVTLLMVFTFGMGVLIGPVLQYALHIADGAKIVGIAAAMTAAVFLTMSALARRTRLDMNALGRFLTVGAVILMVAVVANLFLGIPALALTISAGFVLFSSLMIMWQVRTVIDGGEDSHISAALTLFISLYNIFSSLLNILLSLNGED

SEQ ID NO: 8237 - protein, 88 aa, Neisseria meningitidis
MARMVFCVKLNKEAEGMKFPPLPNELGKRIFENVSQEAWAAWTRHQTMLINENRLSLADPRAREYLAQQMEQYFFGDGADAVQGYVPQ

SEQ ID NO: 8238 - protein, 156 aa, Neisseria meningitidis
MNITVLAVGTKMPRWVDEAVAEYAKRFGRDVAYALKEIKPEKRGAGVNAAQGMAAEEKRILEAIPQGAFLVVLDERGKAPTSVELAEHLKSWRQNGEHVCFVIGGADGMTDRLKQQARMMMRLSSLTLPHGMVRVFLTEQLYRAVSILHNHPYHRE

SEQ ID NO: 8239 - protein, 128 aa, Neisseria meningitidis
MNEQELQDLQKMVGVAVNALGDIKAKDISVLETQDKTSLFARMIIASGDSTRQVKALANNVAVDLKEAGFEILSTEGDSGEWTLVDAGDLVVHVMLPAVRDFYDIDTLWGGEKPSFHAGMQKPWHAAD

SEQ ID NO: 8240 - protein, 201 aa, Neisseria meningitidis
MKKIGLFGGTFDPIHNGHLHIARAFADEIGLDAVVFLPTGGPYHKDAASASAADRLAMVELATAEDARFAVSDCDIVREGATYTFDTVQIFRQQFPSAQLWWLMGSDSLMKLHTWKKWQMLVRETNIAVAMRQGDSLHQTPRELHAWLGKSLQDGSVRILSAPMHNVSSTEIRRNLAGQGVSDGIPPAAARYIREHGLYEK

SEQ ID NO: 8241 - protein, 199 aa, Neisseria meningitidis
MSELDNILAHNRQFVESGEYEKYFTDKYPERGLAVLSCMDARIIGLLPDALGLKNGDAKLIKNAGALVTHPWGSVMRSLLVAVFELKVREIMVIAHHDCGMQGLNAEEFLGRVRESRIPEDRIETLRYAGIDLDGWLTGFDNVEDSVRHTVDLIRNHPLMPRHIAVHGLVIHPVTGKLTLVVDGSVSDGMDLSEGMETS

SEQ ID NO: 8242 - protein, 531 aa, Neisseria meningitidis
MWGLLGTIATSVFQVGKAMDGRRWVVWGAFALLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFVQVPAARLQTARTLGAGAWRRFWDIEMPVLRPWLAGGVCLVFLYCFSGFGLALLLGGSRYATVEVEIYQLVMFELDMAVASVLVWLVLGVTAAAGLLYAWFGRRAVSDKAVSPVMPSPPQSVGEYVLLAFAAAVLSVCCLFPLLAIVVKAWSAGESWRVLMESETWQAVWNTLRFSAAAVYAAAVLGVVYAAAARRSAWMRGLMFLPFMVSPVCVSAGVLLLYPQWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLAAFALGIFLLLDGGEGGKQTETL

SEQ ID NO: 8243 - protein, 461 aa, Neisseria meningitidis; identical to SEQ ID NO: 586

SEQ ID NO: 8244 - protein, 172 aa, Neisseria meningitidis
MTTHFVVMGVCGCGKTTAALSLQKHLGQCPYAEGDEFHTQANRDKMGAGIPLTDEDRYPWLGNLRDWMTQQAQNGANHTIVTCSALKRGYRDILRGAEGKAAFIHLSPPQDINLERMMSRKGHYMKAGMLDSQLEILEELGEGEYGVKIANPGTPEAVEADILNWVASENLL

SEQ ID NO: 8245 - protein, 305 aa, Neisseria meningitidis
MSVYTSVSDDEMRGFLSGYDLGEFVSLQGIAQGITNSNYFLTTTSGRYVLTVFEVLKQEELPFFLELNRHLSMKGVAVAAPVARKDGRLDSVLAGKPACLVACLKGSDTALPTAEQCFHTGAMLAKMHLAAADFPLEMENPRYNAWWTEACARLLPVLSQDDAALLCSEIDALKDNLGNHLPSGIIHADLFKDNVLLDGGQVSGFIDFYYACRGNFMYDLAIAVNDWARTADNKLDEALKKAFIGGYEGVRPLSAEEKAYFPTAQRAGCIRFWVSRLLDFHFPQAGEMTFIKDPNAFRNLLLSLG

SEQ ID NO: 8246 - protein, 242 aa, Neisseria meningitidis
MGGKMSDKKYNVDEGEIAKFSRIADKWWDKSGEFKTLHDINPLRLDYIDGHADLCGKRVLDVGCGGGILAESMARRGAAFVKGIDMAEQSLETARLHAALNNVADIEYECIRVEDLAEAEPHSFDVVTCMEMMEHVPDPAAIVRACANLVKPDGMVFFSTINKNPKSYLHLIVAAEYLLKFVPKGTHDWKKFIAPAELARMCRQAGLDVADTKGMTYHVLSQTYALCDSTDVNYMFACRPAF

SEQ ID NO: 8247 - protein, 413 aa, Neisseria meningitidis; identical to SEQ ID NO: 1342

SEQ ID NO: 8248 - skipped

SEQ ID NO: 8249 - protein, 187 aa, Neisseria meningitidis
MKLIILDRDGVINQDRDDFVKSVDEWIPVEGSMDAVAFLTQAGYTVAVATNQSGIGRKYFTVQNLTEMHAKMHRLVRQAGGEINGIWFCPHTDADNCNCRKPKPGMIEDIIGRFNAQASETWLVGDSLRDLQAIDAVGGKPALVLTGKGKKTLSQHGHELPEHTQVFDTLLDFSQYIMQENTAPQAD

SEQ ID NO: 8250 - protein, 247 aa, Neisseria meningitidis; identical to SEQ ID NO: 2634

SEQ ID NO: 8251 - protein, 230 aa, Neisseria meningitidis
MTAFVHTLSDGMELTVEIKRRAKKNLIIRPAGTHTVRISVPPCFSVSALNRWLYENEAVLRQTLAKTPPPQTAENRLPESILFHGRQLALTAHQDTQILLMPSEIRVPEGAPEKQLALLRDFLERQAHSYLIPRLERHARTTQLFPASSSLTSAKTFWGVCRKTTGIRFNWRLVGAPEYVADYVCIHELCHLAHPDHSPAFWELTRRFAPYTPKAKQWLKIHGRELFALG

SEQ ID NO: 8252 - protein, 265 aa, Neisseria meningitidis
MDTAQKQRWAITLSYDGSRFYGWQKQADGVPTVQAALETALAQIAGEAVSTTVAGRTDTGVHATAQVVHFDTTAARPQQAWVRGVNAHLPEGIAVLHARQVAPEFHARFDAYGRHYRYLLESAPVRSPLLKNRAGWTHLKLDIGQMRQAAALLVGEQDFSSFRAAECQAKSPVKTIYRADLTQSSGLVRLDLHGNAFLHHMVRNIMGALVYVGSGRLSVEGFAALIQERSRLKAPPTFMPDGLYLTGVDYPEAYGIIRPQIPEWL

SEQ ID NO: 8253 - protein, 79 aa, Neisseria meningitidis
MILNIRKMGNSQGVILPKSLLGQIGAVDSLAVTVEKGNIILSCPTVRRGWAEAAAMLVETEQEHFFSEIENEADKEWIW

SEQ ID NO: 8254 - protein, 107 aa, Neisseria meningitidis
MDMVVRGGIYLVSLDPTVGSEIKKTRPCVVVSPPEIHNYLKTVLIVPMTSGSRPAPFRVNVRFQDKDGLLLPEQIRAVDKAGLVKHLGNLDNSTAEKLFAVLQEMFA

SEQ ID NO: 8255 - protein, 331 aa, Neisseria meningitidis
MKKSLIALTLAALPVAAMADVTLYGTIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLRHKF

SEQ ID NO: 8256 - protein, 633 aa, Neisseria meningitidis
MTTPKKTAKTSGNEARELADLSEDIGICFKYPNSERVYLQGSRDDIRVPLREIRQDDTYTAQGTEANPPIPVYDTSGVYGDPAAHIDLKQGLPHIRTAWLDERGDTEILPKLSSEYGIERAHDPKTAHLRFNQITRPRRAKSGSNVTQLHYARQGIITPEMEFVAIRERLKLDELSQKPEYAKLLEQHAGQSFGANIPTHPDQITPEFVRQEIAAGRAIIPANINHPELEPMIIGRNFRVKINGNLGNSAVTSSLTEEVEKMVWSLRWGADTIMDLSTGAHIHETREWIIRNAPVPIGTVPIYQALEKTGGIAEDLTWDLFRDTLIEQAEQGVDYFTIHAGVLLRYVPMTANRLTGIVSRGGSIMAKWCLAHHRENFLYTHFDEICEIMKAYDVSFSLGDGLRPGCIADANDESQFAELHTLGELTDKAWKHDVQVMIEGPGHVPLQRVKENMTEELQHCFEAPFYTLGPLVTDIAPGYDHITSGIGAANIGWYGTAMLCYVTPKEHLGLPDKEDVRTGIITYKLAAHAADLAKGWPGAQLRDNALSKARFEFRWRDQFRLSLDPERAESFHDETLPAEGAKIAHFCSMCGPKFCSMKITQEVRDYADKQKAQRQGMEEKAVEFVKKGAKIYS

SEQ ID NO: 8257 - protein, 291 aa, Neisseria meningitidis; identical to SEQ ID NO: 412

SEQ ID NO: 8258 - protein, 312 aa, Neisseria meningitidis; identical to SEQ ID NO: 2838

SEQ ID NO: 8259 - skipped

SEQ ID NO: 8260 - protein, 591 aa, Neisseria meningitidis
MSIVLHGVAAGKGIAVGCAHLIARGTEEVPQYDVAEADTDAEAERFDAAVKATRKELEQLRSAIPENAPTELGAFISLHLMLLTDVTLSREPVDILREQKINAEWALKQQSDKLAAQFDNMDDAYLRERKQDMLQVVRRIHNNLIGQGNELEVADNLFDETVLIANDLSPADTVLFKEQRIAAFVTDAGGPTGHTAILGRSLDIPSVVGLHNARKLITEGETVIVDGINGVLIIAPDESVLNEYRRRAREYRSHKRDLNKLKKTAAATADGVCIELVGNIESAEDVKPLHNLGADGIGLFRSEFLYLNRDTMPSEDEQYEVYSAIVKKMKGKSVTIRTVDLGVDKNPRWFGKNSTPNGSLNPALGMTGIRLCLAEPVMFRTQMRAILRAAVHGPVRMMWPMITSVSEVRQCLIHLDTAQRQLAERGDAFGKVGIGCMIEIPSAALTVGSILKLVDFISVGTNDLIQYILSVDRGDDSVSHLYQPGHPAVLKMLQHVIRTANRMDKDVSVCGEMAGDTAFTRVLLGMGLRRFSMNPNNILPVKNIILHSNVGQLESDIVKVIRCEDEEKSEKLIKQMNSVSVEEEADFKGRK

SEQ ID NO: 8261 - protein, 89 aa, Neisseria meningitidis
MLKQSIEIINKLGLHARASNKFTQTASQFKSEVWVTKNDSRVNGKSIMGLMMLAAAKGTVIELETDGADEAEAMRALTDLINGYFGEGE

SEQ ID NO: 8262 - protein, 152 aa, Neisseria meningitidis
MRNRTHNMIGLLIITHETIGEAYRKLAHHFFPGGLPENVRILGVQPTEDQDDINNNAIAALQEFPDNDGVLIMTDIFGATPCNAARRLVRENKSAILTGLNAPMMVKAVQYSPAAEDLAAFTECVREAAVKGIFAITSAPEDLVCRRSGDAV

SEQ ID NO: 8263 - protein, 187 aa, Neisseria meningitidis
MTDLETKRLETQAMLENADLLFDQGQCRAALQKVADEITRDLGGKYPLLLPVMGGAVVFTGQLLPLLRFPLDFDYVHVSRYGDKLEGGAFNWKRMPDAEQIRGRHVVVLDDILDEGHTMSAIQAKLLEMGAASCRAAVFANKLIDKPKPIRADYVGLDVPNRYVFGYGMDAAGCWRNLGEIYALGGK

SEQ ID NO: 8264 - protein, 274 aa, Neisseria meningitidis
MIKKTIGGIIPIFTAVFIPASAGAADLMLAQEYKGQDIAGWAMSEKLDGVRAYWDGKHLMSRQGYAFAPPKGFTAQFPPYPLDGELYSGRGQFEQISATVRSVSSDWRGIRLHVFDVPKAQGNLYQRLAVATQWLKTHPNAPITIIPQIKVRDRQHAMDFLKQIEAQGGEGVMLRQPESRYSGGRSSQLLKLKSQYDDECTVTRHYEGKGRNAGRLGAVGCKNRHGEFRIGSGFKDKDRDNPPKIGTLITYRYRGFTRKGTPKFATFVRVRTDR

SEQ ID NO: 8265 - protein, 210 aa, Neisseria meningitidis
MTLRYEIFPVTPFRQNCTLIWDDESGEAVLTDVGGDVPFLLQALANRKLTLTAIWLTHGHLDHAGGVVEMLKTHKVPVLGPHPDDEFLLQSLPQTTAQYGFPVSPAFAPNRWLEEGETLTVGRYAFQVLHIPGHTPGHIVFYCAEAELLIAGDVLFYETIGRTDFPRGNHADLINNIRNKLFTLPETVQVVAGHGRMTSIGHEKRHNPFF

SEQ ID NO: 8266 - protein, 594 aa, Neisseria meningitidis
MELMTVLLPLAALVSGVLFTWLLMKGRFQGEFAGLNAHLAEKAARCDFVEQAHGKTVSELAVLDGKYRHLQDENYALGNRFSAAEKQIAHLQEKEAESARLKQSYIELQEKAQGLAVENERLATQLGQERKAFADQYALERQIRQRIETDLEESRQTVRDVQNDLSDVGNRFAAAEKQIAHLQEKEAEAERLRQSHTELQEKAQGLAVENERLATQIEQERLASEEKLSLLGEARKSLSDQFQNLANTILEEKSRRFTEQNREQLHQVLNPLNERIHGFGELVKQTYDKESRERLTLENELKRLQGLNAQLHSEAKALTNALTGTQNKVQGNWGEMILETVLENSGLQKGREYVVQAASVRKEEDGGTRRLQPDVLVNLPDNKQIVIDSKVSLTAYVRYTQAADADTAARELAAHVASIRAHMKGLSLKDYTDLEGVNTLDFVFMFIPVEPAYLLALQNDAGLFQECFDKRIMLVGPSTLLATLRTVANIWRNEQQNQNALAIADEGGKLYDKFVGFVQTLESVGKGIDQAQSSFQTAFKQLAEGRGNLVGRAEKLRLLGVKAGKQLQRDLVERSNETTALSESLEYAAEDEAV

SEQ ID NO: 8267 - protein, 266 aa, Neisseria meningitidis
MRAAKMKQTLKNWFAALLLAVPMSAAVASGGGHYEKVDIDLRDQVSLQHGAQIFTNYCLSCHSASGMRFNRLKDIGLTDEEIKKNLMFTTDNVGDVMHSAMNPKDAAKWFGAAPPDLTLIARSKGADYLYAYMRGFYKDPTRPSGWNNTVFDKVGMPHPLWEQQGVQAVELDAKGQPVMVKDEHGEMKPKLYWESTGLHSRRLPNGKVIQKEYDAYVRDLVNYLVYMGEPAQLQRKRIGYVVMIFLFAVMLPLAYFLNKEYWKDVH

SEQ ID NO: 8268 - protein, 449 aa, Neisseria meningitidis
MANQTNSKAKALLGWVDARFPLSKMWKEHLSEYYAPKNFNFWYFFGSLSMLVLVIQIVSGIFLTMNYKPDGNLNAYHLPAAFTAVEYIMRDVSGGWIIRYMHSTGASFFFIVVYLHMFRGLIYGSYKKPRELVWIFGSLIFLALMAEAFMGYLLPWGQMSFWGAQVIINLFSAIPVIGPDLSTWIRGDFNVSDVTLNRFFALHVIAVPLVLLGLVVAHIIALHEVGSNNPDGVEIKKLKDENGVPLDGIPFFPYYVVHDILAVTIFLIVFCAVMFFAPEGGGYFLEAPNFDAANALKTPPHIAPVWYFTPFYAILRAIPSFAGTQVWGVIGMGAAVVLIALLPWLDKGEVKSVRYRGPIFKTALVLFIIAFIGLGILGAMVATDTRTLVARILSFVYFAFFLGMPFYTKLDTNKPVPERVTMSTTKQKIMFFVYVGITVVGAYLFATNI

SEQ ID NO: 8269 - protein, 193 aa, Neisseria meningitidis
MDNQEINNGRRRFLTLATCGAGGVAALGVATPFVASFFPSEKAKAAGAAVEVDVSKIEAGQLLTAEWQGKPIWVLNRTDQQLKDLKGLNGELTDPNSDAEQQPEYAKNETRSIKPNILVAIGICTHLGCSPTFRPDIAPADLGADWKGGFFCPCHGSKFDLAGRVYKGVPAPTNLVVPPYKYLSDTTILVGED

SEQ ID NO: 8270 - protein, 249 aa, Neisseria meningitidis
MVLCRDFLTWCNETLQTALFKDYAPNGLQVEGREYIGKIVTSVTASRAAIDFAVEQKADLLLVHHGMFWKNELPTVTGWKKERIAALLRHDINMAGYHLPLDAHPTLGNNAQLADRLGFATEKRFGEQNLLNSGSLKQAKTLGALAAHIETVLQRKPVVIGNPEREIRRVAWCSGGAQGFFQTAIDEGVDLYLTGEISEAQYHLANETGTAFISAGHHATERYGVRALAESAAEVFGLEVCHFDENNPA

SEQ ID NO: 8271 - protein, 309 aa, Neisseria meningitidis
MDSIIELRHLKTLLALEETGSVSLAAKRVFLTQSALSHQIRMLENHYGTPLFERKSTPLRFTPVGERLLRLAHELIPQVAVAEWDLARITEGEAGELRIAVECHTCFDWLMPAMGEFRPMWPQVELDIVSGFQADPVGLLLQHRADLAIVSEAEKQNGISFQPLFAYEMVGICAPDHPLAAKNVWTAEDFIGETLITYPVPDEMLDLPKKILIPKNINPPRRHSELTIAIIQLVASRRGIAALPYWTVMPYLEKGYVVHRQITADGLQSKLYAAIRTEDTDKSYLNNFCQIIRERGFADLPGLSELEPV

SEQ ID NO: 8272 - protein, 130 aa, Neisseria meningitidis
MNGKYYYGTGRRKSSVARVFLIKGTGQIIVNGRPVDEFFARETSRMVVRQPLVLTENAESFDIKVNVVGGGETGQSGAIRHGITRALIDFDAALKPALSQAGFVTRDAREVERKKPGLRKARRAKQFSKR

SEQ ID NO: 8273 - protein, 143 aa, Neisseria meningitidis
MKTFSAKPHEVKREWFVIDAQDKVLGRVAAEVASRLRGKHKPEYTPHVDTGDYIIVINADKLRVTGAKFEDKKYFRHSGFPGGIYERTFREMQEQFPGRALEQAVKGMLPKGPLGYAMIKKLKVYAGAEHAHAAQQPKVLELK

SEQ ID NO: 8274 - protein, 101 aa, Neisseria meningitidis
MNIEQVHIEVMHARLTVNTPAEEKDTLLQAVGMLNGKAEAIREGGRVADSEKIVIMAALNVVHDLLKTSLNGGDLAIGDFARKIADMDNACQKALSRLAQE

SEQ ID NO: 8275 - protein, 109 aa, Neisseria meningitidis
MKQNIEKLESSVYTLVQKFETLVSENRRLKETVAELKRAHERQKLEHETAVDELSEALLVQVGKLKEDLQNKIDSLTEENTRYRSLLEQSREKISALAARLPQWQETQQ

SEQ ID NO: 8276 - protein, 329 aa, Neisseria meningitidis
MKITVIGAGSWGTALALHFSQHGNRVSLWTRNADQVRQMQEARENKRGLPGFSFPETLEVCADLADALKDSGLVLIVTSVAGLRSSAELLKQYGAGHLPVLAACKGFEQDTGLLTFQVLKEVLPDNKKIGVLSGPSFAQELAKQLPCAVVLASENQEWIEELVPQLNTTVMRLYGSTDVIGVAVGGAVKNVMAIATGLSDGLEYGLNARAALVTRGLAEITRLASAMGAQPKTMMGLAGIGDLILTCTGALSRNRRVGLGLAEGKELHQVLVEIGHVSEGVSTIEEVFNTACKYQIDMPITQTLLQLIRKEMTPQQVVERLMERSARFE

SEQ ID NO: 8277 - protein, 900 aa, Neisseria meningitidis
MQLHILNNPKDAALAADAEFLKQSLFNLLHEEASPLVVETVKLLSTSDDSAALIEKVLPQLDEQQTHDLTLACGLFAQILNIAEDVHHERRRQIHEEAGRGGAEGSLTETVRRLKAGKADGKSVQRQLDNTSVTAVLTAHPTEVQRQTVLSFNRRIRALLPQRERCTNADALARLRREIDTILLGLWQTSETRRHKLSVNDEINNGVSIFPMSFFEALPKLYRKMEHDFQTAYPGVRVPDILKIGGWIGGDRDGNPFVSAETLRFAFRRHADAVFRFYRGELDKLYRELPLSIRRVKVNGDVTALSDKSPDEEIARAEEPYRRAIAYIMARAMGKARALGLGMGCKFGFLEPYASAQEFLDDLKKLQRSLIDNGSRLLAEGRLADLIRSVSVFGFHMMPLDLRQHAGKHADVVAELFQHAGLEDYNRLNEEQKQTALLRELSHQRPLYSPFITYSDHTRHELAIFNEARKIKDEFGEDAVTQSIISNCEQPSDLLALALLLKETGLLAVENGKPHSRINIVPLFETIEALENACPVMETMFRLDWYDALLESRGNIQEIMLGYSDSNKDGGYVTSSWCLYQAELGLVELFKKYDVRMRLFHGRGGSVGRGGGPSYQAILAQPAGSVAGQIRITEQGEVITAKYADPGNAQRNLETLVAATLEASILPDKKDPDAKLMQALSDVSFKYYRELITHPDFIDYFLQTSPIQEIATLNLGSRPASRKTLARIQDLRAIPWVFSWMQNRLMLPAWYGFGSAVETLCEDKPETLAALREHAQSNPFFQAMLSNMEQVMAKTDITLAENYAGLSESPDKAKIIFGMIKEEYRRSRKALLDLLQTEELLRDNRSLARSLALRIPYLNALNGLQVAMLKRLRKEPDNPHALLMVHLTINGVAQGLRNTG

SEQ ID NO: 8278 - protein, 256 aa, Neisseria meningitidis
MTTTEHDNDDAFLLRYSRHILLDEIGIEGQQKLSAAHILVVGCGGLGAAALPYLAASGVGTLTIADSDTVELHNLQRQVAFDEGDVGKLKTEALAGRLKRINHTVNVRAVNEKLDGCRLTGLVQAADIVLDCCDNYATRQAVNRACVQTKTPLVSGAAVRFEGQLAVYRPDLPDSPCYACLFDGGSASDGICSLFGVFSPLVGIIGSTQAAEALKILLDAGEPSHGRLAVYRALEGGWQYFDLPRNPECPVCGTAR

SEQ ID NO: 8279 - protein, 74 aa, Neisseria meningitidis
MDAVQELERRIVELEIQSALQEDVIAGLNAMVAELRQTLDLQQAQLRLLYQKMQDRNPDAQEPYSLRDEIPPHY

SEQ ID NO: 8280 - protein, 462 aa, Neisseria meningitidis
MNAVVVAVIVMLVLSLSRVHVVLSLTVGAFVGGAVAGMPLQNIADAAGQVSQAGIIPVFNKGLEGGAKIALSYAMLGAFAMAITHSGLPQQLAGAVVRKLNRGGMPDSVRSGEGAVKWLLLSIILVMGMMSQNIIPIHIAFIPMIVPPLLLVFNRLKIDRRLIACVITFGLVTTYMFLPYGFGAIFLNEILLGNIHSAAPQLDVKNINVMAAMAIPALGMLAGLLLAFVHYRKPRLYQSNNADTAGNADAANRPQPSAYRSLAAAVAIAVCFAIQLMYEDSLVLGAMLGFAVFMMLGVINRDKANDVFGEGIKMMAMVGFIMIAAQGFAAVMNATGHIQPLVESSMAIFGNSKGMAALAMLVVGLLVTMGIGSSFSTLPIIAAIYVPLCVGLGFSPLATVAIVGTAGALGDAGSPASDSTLGPTMGLNADGQHDHIRDSVIPTFIHYNIPLLIAGWIAAMVL

SEQ ID NO: 8281 - protein, 423 aa, Neisseria meningitidis
MQEQNRKPSFPIVMLLVSVALWIASLSNVAFYLGNHGSMEGLTVLILGSIFASLDIRYCAVYANYVWLAAIVLLALRKKVVPVHAALWGLALVAFSVKAVYVDEAGNTSDIVRYGAGFYLWYAAFAVATIGTFAGKNKERKAASAADGIKMTFDKWLGLSKLPKNEARMLLQYVSEYTRVQLLTRGGEEMPDEVRQRADRLAQRRLNGEPVAYILGVREFYGRRFTVNPSVLIPRPETEHLVEAVLARLPENGRVWDLGTGSGAVAVTVALERPDAFVRASDISPPALETARKNAADLGARVEFAHGSWFDTDMPSEGKWDIIVSNPPYIENGDKHLLQGDLRFEPQIALTDFSDGLSCIRTLAQGAPDRLAEGGFLLLEHGFDQGAAVRGVLAENGFSGVETLPDLAGLDRVTLGKYMKHLK

SEQ ID NO: 8282 - protein, 480 aa, Neisseria meningitidis
MHPTYSAVQARLLEANRLSPELLAKSLCIIGAHHVDYADIYCQRTAYESWHLEEGIVKSGSFQINQGVGVRAVSGDKTAFAYADSLCIDSINRSARAVRAIGAAGGKVSAKMPSETRGKPVCSASDPIAGLDSAAKVALLNKVEAIAKAADPRIVQVMAGLTCEYDMVYLARLDGKHAADIRPMVRLNVTVIAKQGERREQGSAGGGGRYDLAYFDENLVHRFVDAAVKQALTNLESRPAPAGEMTVVLGNGWPGVLLHEAVGHGLEGDFNRKGTSVFSGRIGERVAAKGVTVVDQGDIAGRRGSLNIDDEGNETRRTVLIEDGILVGYMQDETNARLTGTQSTGNGRRESYASAPMPRMTNTFMENGSYEPEEIIASIDKGIYAVNFGGGQVDITSGKFVFSASEAWWVEGGRLQYPVKGATIIGNGPEVLKHVSMIGNDTALDSGVGVCGKEGQSVPVGVGQPTLRIDAGLTVGGSAI

SEQ ID NO: 8283 - protein, 407 aa, Neisseria meningitidis; identical to SEQ ID NO: 802

SEQ ID NO: 8284 - protein, 366 aa, Neisseria meningitidis; identical to SEQ ID NO: 812

SEQ ID NO: 8285 - protein, 205 aa, Neisseria meningitidis
MTFPPLKSPLKFYAVVPTADWVGRMVKAGADTVQLRCKALHGDELKREIARCAAACQGSRTQLFINDHWREAIEAGAYGVHLGQEDMDTADLAAIAAAGLRLGLSTHSVAELDRALSVHPSYIASGAIFPTTTKQMPTAPQGLDKLREYVKQAGGTPVVAIGGIDLNNARAVLATGVSSLAAVRAVTEAANPEAVVKAFQALWDG

SEQ ID NO: 8286 - protein, 64 aa, Neisseria meningitidis
MNIILNGGPAELHGTTVADLIAQTAPQKPFAVAVNTVFVPKGAYAETVLNENDKIDIVRPVVGG

SEQ ID NO: 8287 - protein, 262 aa, Neisseria meningitidis; identical to SEQ ID NO: 1454

SEQ ID NO: 8288 - protein, 47 aa, Neisseria meningitidis
MEKPAGKPCRPSRCRNQRNTRPPRCAGCRASPKYGNRRSVLLLFEYT

SEQ ID NO: 8289 - protein, 67 aa, Neisseria meningitidis
MTTLSAPNRTDVQTRATLFPSGTKPSAMPADPDLSDTMKVCRPESQTSADRLICLFFIVLQKICIYF

SEQ ID NO: 8290 - protein, 288 aa, Neisseria meningitidis
MKWLFILLVAINIAVFGGTVGYKLTLKQAGRIPEAQNAANNLQVQPVAPTMPVVRNIPASGPVVQAASESDTGALLKQGDILSEEQAEQLRLKKEAEQKKLKEKKQREEKARREKLAAEKAQAERENGAADALCAAQASLTMDEDDYHRIKGLLGKWSHVASRSVEKRTAQAKPADKTYRVVLPVSADAENQAAELSAKGFNPIPFDGALSLGVGNSRENAQALQNRLAGAGFGGAHIVEHFAEADRQDDSLSVSRMTVLFTGVNAADADEIRKITSLYGKLNLKSCK

SEQ ID NO: 8291 - protein, 592 aa, Neisseria meningitidis; identical to SEQ ID NO: 234

SEQ ID NO: 8292 - protein, 168 aa, Neisseria meningitidis
MVDAWSVPDFESKICPPEALAARLALLPRPLVFTNGCFDILHRGHVTYLAQARSMGDALVLALNTDASVRRLGKGGDRPVNPLENRAAVAAALESVDLVTWFDGDTPAALIEAVKPEILVKGGDWAADKIVGAAETLARGGQVFSIPFLHQTSTTKTLAKIRAAEGGK

SEQ ID NO: 8293 - skipped

SEQ ID NO: 8294 - protein, 193 aa, Neisseria meningitidis
MEEKNDYTDAASDNRNGQEIEVGIAGAGDRILAALLNQLFTFLVLLVPFAGLIAFAIKNEGRIGSGEEIFGLLLGMTSFWVGLAGILAYTVIQIYYMSRDGQSLGKKIMRIRVLKTDGRNPGFVGTVLVREIAWSVLVAIIAAVIGLAVGDNGENAINLLAFLANFVLLFMVKRDRRTLYDILADTVVVKLPK

SEQ ID NO: 8295 - protein, 371 aa, Neisseria meningitidis
MKVGFVGWRGMVGSVLMQRMKEENDFAHIPEAFFFTTSNVGGAAPDFGQAAKTLLDANNVAELAKMDIIVTCQGGDYTKSVFQALRDSGWNGYWIDAASSLRMKDDAIIVLDPVNRDVLDNGLKNGVKNYIGGNCTVSLMLMALGGLFQNDLVEWATSMTYQAASGAGAKNMRELISGMGAVHAQVADALADPAGSILDIDRKVSDFLRSEDYPKANFGVPLAGSLIPWIDVDLGNGQSKEEWKGGVETNKILGRSDNPTVIDGLCVRVGAMRCHSQAITLKLKKDLPVSEIETILAGANDWVKVIPNEKEASIHELTPAKVTGTLSVPVGRIRKLGMGGEYISAFTVGDQLLWGAAEPLRRVLRIVLGSL

SEQ ID NO: 8296 - protein, 176 aa, Neisseria meningitidis
MQGFELEDLTLWLIRDAGEDQMWIDRWAISYPVVQMSEASAGQSIGEWQAGLQTAFERIRGKYVAVVAHGAGAAAFLAWLYQADILTRKKIANIILVPQRPDIFPDDAEHAFQRVRCPCRAALVVPEHGGVPHGWAQKQADLWNARLLVSPHSGSLNGMLGGWQWGMKLMQEMLLA

SEQ ID NO: 8297 - protein, 114 aa, Neisseria meningitidis
MLPNKVLGKYDWNVDGKTGIGAAWVVAAFILPMLVWAIFMLSRMQGWLAPTKANPIWALVWLLICLPCLLIASKCLGWKGWRRVVNIFACLTVCAILSVPASLLIAFTLRDLLK

SEQ ID NO: 8298 - protein, 259 aa, Neisseria meningitidis
MLKIISANVNGIRSAYKKGFYEYIAASGADIVCVQELKAQEADLSADMKNPHGMHGHWHCAEKRGYSGVAVYSKRKPDNVQIGMGIEEFDREGRFVRCDFGRLSVISLYLPSGSSAEERQQVKYRFLDAFYPMLEAMKNEGRDIVVCGDWNIAHQNIDLKNWKGNQKNSGFLPEEREWIGKVIHKLGWTDMWRTLYPDVPGYTWWSNRGQAYAKDVGWRIDYQMVTPELAAKAVSAHVYKDEKFSDHAPLVVEYDYAAE

SEQ ID NO: 8299 - protein, 473 aa, Neisseria meningitidis
MTTIYNTLTRQKEPFSPIDPENVRMYVCGMTVYDYCHLGHARVMVVFDMIARWLRECGYPLTYVRNITDIDDKIIARAAENGETIGKLTARFIQAMHEDADALGVLRPDIEPKATENIPQMIAMIETLIQNGKAYPAANGDVYYAVREFAAYGQLSGKSLDDLRAGERVEVDGFKRDPLDFVLWKAAKAGEPAWESPWGNGRPGWHIECSAMSENLFGDTFDIHGGGADLQFPHHENEIAQSVGATGHTCGHHHAQTHHGQSIASHVKYWLHNGFIRVDGEKMSKSLGNFFTIREVLKQYDPEVVRFFILRAHYRSPLNYSDAHLDDAKGALTRLYTTLKNTPPADPMPSEAGDDYTRRFYVAMNDDFDTVKAVAVLFELAGEVNKTNDAQLAGRLKALGGIIGLLQRDPTEFLQGGAASDGLSNEEIEDLIARRKQARADKNWAESDRIRDLLNEHKIILEDNAGGTTWRRG

SEQ ID NO: 8300 - skipped

SEQ ID NO: 8301 - protein, 349 aa, Neisseria meningitidis
MSSNQYIQSLELTNFTVLPNDTFEFSENLNVIVAENGCGKTHLLKILYSLLEVTSNTKNRLLKTELQKSFADKLLNVFRPDSLGRLSKRLQGRGRTEIVLKLQNGTTHSSLNFSSNSSSQVNVQSIGLKENEYTPTPIFLPSRELITLCPWFTSLYQNQSIPFEETWFDTCMQLNHPLAKGPRETKIRELLEPIENAMGGKVSEEQGRFYLSLTNTGGKIEAPLVAEGLRKFVMIARLIATGALLDKGYLFWDEPEANLNPKLIKVAARIIWSLSQQGIQVFIATHSLFLLRELELLKLENNTDLPVRFFSLIASDDGTKVEQGNSINDLNTLILLDENIMQADRYLNI

SEQ ID NO: 8302 - protein, 384 aa, Neisseria meningitidis
MKFIDEAKIEVAAGKGGNGATSFRREKFVPRGGPDGGDGGKGGSVWAEADENTNTLVEYRFVKRYQAKNGEKGHGSDRYGAGADDIVLKMPVGTLIRDLDTGETVADLTYHGQRVCLAKGGKGGLGNIHFKSSVNRAPKQSTPGEEGEARSLQLELKVLADVGLLGMPNAGKSTLITAVSAARPKIANYPFTTLHPNLGVVRIDENHSFVMADIPGLIEGAAEGAGLGHRFLKHLSRTGLLLHVVDLAPFDETVNPAEEALAIINELRKYDEELYGKPRWLVLNKLDMLDEEEAQTRTAAFLEAVGWDYPKPDDRFQFDMETPRLFQISALTHQGTQELVHQINQYLTEKKRIEAEKAEAEKAAANVEIIEQQPKTDTGVFKPE

SEQ ID NO: 8303 - protein, 120 aa, Neisseria meningitidis
MATCPATAANSSKPKLPWNVLPKFAIHSIFSGEPLHHFNAEHFQRAAAAAVLADHADNGNSKHEQIQNAVACRRSLAVALRTLGAVGNRPHDAQCNHRQRKETERFVQAEQAAHPFRLFV

SEQ ID NO: 8304 - protein, 291 aa, Neisseria meningitidis; identical to SEQ ID NO: 288

SEQ ID NO: 8305 - protein, 115 aa, Neisseria meningitidis
MRLNHKQGEAGEDAALAFLQSQGCTLLARNWHCAYGEIDLIVKNGGMILFVEVKYRKNRQFGGVAYSISPSKLLKLQRSVEYYLQQNRLTNVPCRLDAVLIEGSRPPEWIQNITG

SEQ ID NO: 8306 - protein, 197 aa, Neisseria meningitidis
MTTLQERVAAHFAESIRAKQEAGKVLVEPTVQAAELMLQCLMNDGKILACGNGGSAADAQHFAAEMTGRFEKERMELAAVALTTDTSALTAIGNDYGFDHVFSKQVRALGRAGDVLVGISTSGNSANVIEAVKAAHERDMHVIALTGRDGGKIAAILKDTDVLLNVPHPRTARIQENHILLIHAMCDCIDSVLLEGM

SEQ ID NO: 8307 - protein, 202 aa, Neisseria meningitidis; identical to SEQ ID NO: 3866

SEQ ID NO: 8308 - protein, 210 aa, Neisseria meningitidis
MPSEPPSDGIARHPKSTIKMAKKPNKPFRLTPKLLIRAVLLICIAAIGALAIGIVSTFNPNGDKTLQAEPQHTDSPRETEFWLPNGVVGQDAAQPEHHHAASSEPAQPDGTDESGSGLPSPAAPKKNRVKPQPADTAQTDRQPDDAGTQAENTLKETPVLPTNVPRPEPRKETPEKQAQPKETPKENHTKPDTPKNTPPKPHKEILDNLF

SEQ ID NO: 8309 - protein, 259 aa, Neisseria meningitidis
MNGIIIKTPEEIEKMRELGKLVAEALDYIGQFVKPGVTTDEIDKLVYDYHVNVQGGYPAPLHYGNPPYPKSCCTSVNHVICHGIPDDKPLKEGDIINIDLTIKKDGFHGDSSRMFTVGKVSPIAQRLIDVTHASMMAGIEAVKPGATLGDVGYACQQVAENAGYSVVQEFCGHGIGRGFHEAPQVLHYGKKGQGPVLKPGMIFTVEPMINQGKRHLRILNDGWTVVTKDRSLSAQWEHEVLVTETGYEILTVSPASGKP

SEQ ID NO: 8310 - protein, 99 aa, Neisseria meningitidis
MKIFENIEDVKAIRKKTGLNQIDFWGKVGVTQSGGSRYETGRKMPKPVRELLRLVHIECIDLAKVNKKDMEIAALLKKHHPDLYAELSKQTKSERKKQS

SEQ ID NO: 8311 - protein, 124 aa, Neisseria meningitidis; identical to SEQ ID NO: 906

SEQ ID NO: 8312 - protein, 488 aa, Neisseria meningitidis; identical to SEQ ID NO: 1676

SEQ ID NO: 8313 - protein, 29 aa, Neisseria meningitidis
MLATHSNPETAYSDTHHCRFSLLLRFRRL

SEQ ID NO: 8314 - protein, 196 aa, Neisseria meningitidis
MSEKIILPVLSLGGVRLEPLDVHHETGLREAVCDGEVWKLGVTSAPHPDRVADYIGTALATRLAFAVVDEEAGRVVGTTAYYHFEPQIPRLDIGFTWYAASARRTRINTCCKIMLLDSAFDVLACRCVGWRTDILNLASQRAIERLGAEKDGVLRMHMLRKDGSVRDTVVYSMLREDWCKNREILTGRLAGYGVQV

SEQ ID NO: 8315 - protein, 193 aa, Neisseria meningitidis; identical to SEQ ID NO: 1634

SEQ ID NO: 8316 - protein, 77 aa, Neisseria meningitidis
MWHIVAIGYLFVAVMYSAAQPSIARALIYLVFWAVLPTVFTVFTITVRRRNHLMRQQEQAESEQQRAQRQKDSGTKP

SEQ ID NO: 8317 - protein, 242 aa, Neisseria meningitidis
MSQITMRQMIEAGVHFGHQTRFWNPKMAQYIFGARNKIHIVNLEKTLPMFQDAQEAVRRLVANKGTVLFVGTKRQARDIIREEATRAGMPFVDYRWLGGMLTNYKTVKQSIKRLEEKTAALENAAESGFSKKEILEMQRDVEKLERSLGGIKNMKGLPDAIFVIDTGYQKGTLVEAEKLGIPVIAVVDTNNSPDGVKYVIPGNDDSAKAIRLYCRGIADAVLEGKNQALQETVAAAQEAAAE

SEQ ID NO: 8318 - protein, 284 aa, Neisseria meningitidis
MAEITAKMVADLRAATGLGMMECKKALVEAEGNFDKAEEILRIKSGAKAGKLAGRTAAEGVLAYAINGNVGALVEVNCETDFVAKDAGFVEFANFVAKTAAEKKPASVEELSELVEAERKAIIAKLGENMSVRRFQVIDTANQLVAYIHGALATEGVLVEYKGSEDVARKIGMHIVAAKPQCVSEAEVDAETVEKERHIYTEQAIASGKPADIAAKMVEGRIRKFLAEITLNGQAFVMNPDQTVAQFSKENGTEVISFVRYKVGDGIEKKAVDYAAEVAAAAKV

SEQ ID NO: 8319 - protein, 239 aa, Neisseria meningitidis
MTQQIKYKRVLLKLSGESLMGSDPFGINHDTIVQTVGEIAEVVKMGVQVGIVVGGGNIFRGVSAQAGSMDRATADYMGMMATVMNALALKDAFETLGIKARVQSALSMQQIAETYARPKAIQYLEEGKVVIFAAGTGNPFFTTDTAAALRGAEMNCDVMLKATNVDGVYTADPKKDPSATRYETITFDEALLKNLKVMDATAFALCRERKLNIVVFGIAKEGSLKRVITGEDEGTLVHC

SEQ ID NO: 8320 - skipped

SEQ ID NO: 8321 - protein, 483 aa, Neisseria meningitidis; identical to SEQ ID NO: 166

SEQ ID NO: 8322 - protein, 118 aa, Neisseria meningitidis
MNEHNLLIFCLKDNVSISEYTEMVDWAYENIQSETVVEITENQIIEYQNRGLWGLVSEITDNWLFGPSEGDWLIDKESILAVKEKLQNSDFSTEPLVKNIIHVLEYAIKNEKTVIFHF

SEQ ID NO: 8323 - protein, 254 aa, Neisseria meningitidis
VGFSNPIFSNSGISETIDASNIFVGYKYPTYISAQQTLQDINELGNLSPEAQLAAASLLQDSAFAVKDGINSARQWADAHPNITATAQTALAVAEAATTVWGGKKVELNPTKWDWVKNTGYKTPAVRTMHTLDGEMAGGNRPPKSITSNSKADASTQPSLQAQLIGEQISSGHAYNKHVIRQQEFTDLNINSPADFARHIENIVSHPTNMKELPRGRTAYWDDKTGTIVIRDKNSDDGGTAFRPTSGKKYYDDL

SEQ ID NO: 8324 - protein, 68 aa, Neisseria meningitidis
MNILSINNQNSTISLTQDEVFVLRAILNEIYAGVCVDSREFENVSGVRKHEVDNLQQQFAGIYKKMTT

SEQ ID NO: 8325 - protein, 83 aa, Neisseria meningitidis
MDNTRIMAAREAGVKVEANVHNFNDRLSSKERIRFKHDGIEPQTWGEAIQLRIRKQETQKGVPEGWSKRFPNGSIYDVKVLRK

SEQ ID NO: 8326 - protein, 123 aa, Neisseria meningitidis
MIKQNSFVPYPEAMLPKGFKYPQSYLKLAQSTHAINYDEQYSFPWWFENAESNISEVIDIYFEITGIPNLLPFARNQEWAACFDISDKSGNPKIIVVNLDNTKYYETFENFDTWLKEAENDGW

SEQ ID NO: 8327 - protein, 281 aa, Neisseria meningitidis
VGFSNPTFFNSGISETIDASNIFVGYKYPTYISAQQTLQDINELGNLSPEAQLAAASLLQDSAFAVKDGINSARQWADAHPNITATAQTALSVAEAATTVWGGKKVNLNPTKWDWVKNTGYKTPAARPMQTLDGEMAGGNKPPKPSTQQHPTHSDNNIGLPASYVKPDTSISPTGTIQDRIRWTKSKFPTEKSLNGHFKAHGKEFGDITIEDYQKMASDLLSKQTSDKILGYQTEHRRVRYDINNNIYVLANPKTFKIKTMFKPNLGKKYYDGEFKKDMGN

SEQ ID NO: 8328 - protein, 89 aa, Neisseria meningitidis
MMTESHGYLSNNLPVKIINDIIYATQLVEDLVLGKIKIVDFLKSYNNFYCWLGFDELPQSEKIKFLSYLNILSIHKEIQDETVNRVYTD

SEQ ID NO: 8329 - protein, 100 aa, Neisseria meningitidis
MLNEIFEIYSRQGESLIGIGIREAALPVPIAIDILNLFINERILVLGGDIYIKKDNYFYQTYDNWYYEGSNLFNSIDKAMHYLSQIKLENAYVSFVLKFI

SEQ ID NO: 8330 - protein, 212 aa, Neisseria meningitidis
KCWVLIQPTLTGSDTAAQQTLQGINDLGNLSPEAQLAAASLLQDSAFAVKNGINSARQWADAHPNITATAQTALSVAEAAGTVWRGKKVELNPTKWDWVKNTGYKKPAARPMQTVDGEMAGGNKSLKIGTQSVEKSTGRTIPNNLKEQLAMEEVKANPQGKTPARIPPMSDTKNGWLAKDGWVKRVQNVNKIEIHYIENSRTGEKTDFKFKD

SEQ ID NO: 8331 - protein, 114 aa, Neisseria meningitidis
MFLDDVNVFLDDLNVFLDDLNTNPITDEWYMSNFADKHIKILESYEAFDILKQFVDYMIEEYDEKSEYEIMEILRQLKYQADTNEKFYTNTQKQKIVELYKQEISQDILNEIFR

SEQ ID NO: 8332 - protein, 114 aa, Neisseria meningitidis
MIIEHNGNIHKIARMTGNKNNFLEIILSDIHENIKIKPLTIKVKGENVINILPEEVSFYVKQGVDLIYEKYKRKFFISEISFCQSDSRPSSIYAFLTFHLLEDIIKNESPSNYT

SEQ ID NO: 8333 - skipped

SEQ ID NO: 8334 - protein, 105 aa, Neisseria meningitidis
MKKNIFHNVSLYEIIFSDNGNTLTLSFTDTIEGNYFGYIKCSNILNFKLDTNNFVDYEDKEDSLFPLFIPEIELYKYQFYSEIIIDVGIIIKISAETINFEPLGK

SEQ ID NO: 8335 - protein, 252 aa, Neisseria meningitidis
KYSCYISAQQTLQGINNSGKLSPEAQLAAASILQDSAFAVKDGINSARQWADAHPNITATAQTALAVAEAAGTVWRGKKVELNPTKWDWVKNTGYKKPAVRHMQTKALGTVDEIGDTVQQVGKQASGQKTSGGNPAIDSDPYSPSSVAARIEAGKARSDLQIKDILSNTTQRSKTKGPAVQYDKVGDYNDALNDFNSLNVRNVQTRPNGTITGNLPDGRAVNARNDSSGGEPTLEITISNNRKIKIRYGNTR

SEQ ID NO: 8336 - protein, 133 aa, Neisseria meningitidis
MKLKSLDFPTGYFYFDNAAINSDKVEVIAVGYRNTDKTIKIFIEDVIHFRVVDESYFIDTFMDLISEDADRALLHENGGQSFFELLDECYAEWILKESYFPLNREFFKYYIFMFEQTFIEIIGSSATYSIIEG

SEQ ID NO: 8337 - protein, 114 aa, Neisseria meningitidis
MNLENYENILIKLLFYHNNLVNEYSYFIENKNLFKIVSRTKTSKGFFFTIEKPLNFLSKKTYFEFNFKYLHSGKERFGSFMCWINTNLMEFEGVFFNDLLPDNMIINNFFEIND

SEQ ID NO: 8338 - protein, 34 aa, Neisseria meningitidis
MDDIRGIIQGAVNPLIYKVSKQKIIYNNKLISGT

SEQ ID NO: 8339 - protein, 118 aa, Neisseria meningitidis
MNEHNLLIFCLKDNVSISEYTEMIDWAYKNIQSETVVEITENQIIEYQNRGLWRLVSEITDNWLFGPSEGDWLIDKESILAVKEKLQNSDFSTEPLVKNIIHVLEYAIKNEKTVIFHF

SEQ ID NO: 8340 - protein, 42 aa, Neisseria meningitidis
MPQTWGEAIQFRIKKQIENELAPPNWSTQFPNGSIYDPKVTK

SEQ ID NO: 8341 - protein, 124 aa, Neisseria meningitidis
MIIQNEFNLYPSNMLPERFCYPEKYVRISNDTSLIPYIQPHNFHWWFENYGTEGAEVAYIFRNSILPDLNLIPFASNGEWEAYFDGNDVTGNSRVIVINLDNIENHEFFNSFEDWLELAIKDTW

SEQ ID NO: 8342 - skipped

SEQ ID NO: 8343 - protein, 328 aa, Neisseria meningitidis
MQYRIRRENEAPEAKNAGETLWERDIMREVLLSAYQDRRRERMWKNIWRAVSTLILVALIAGIFRKDEAALQLAGNTPHTAVVNLYGEIGNGVEDQVKKLKDGMEAAYKNPQAKAIVIRANSPGGSPVVSNTAFEEIRRLKAQHPGIPVYLVAEDMCASGCYYIAAAADKIYADPSSIVGSIGVIGSSFDATGLMEKIGVKRRVKIAGSNKGMGDPFSPETPEQSKIWEEMLTGIHGEFIKAVKTGRGGRLKFRQYPDVFSGRVYTGADALKVGLVDGLGNIYSVARDVVKAPDVVDYTPKDDFGRILGRRFGAELKASVREALQAVR

SEQ ID NO: 8344 - protein, 266 aa, Neisseria meningitidis
MNAFNLIIIGDEILHGSSQDKHFAFFKSLLESKGLKLNQVQYLPDEPDLLVRQLRRSFSDGMPTFVTGGIGATPDDHTRQAAAAALDLPVVRHSEAAKFIEGITQKRGEPLDSPEHAQRLKMADFPEGAELVPNPFNNIAGFSIREHYFFPGFPVMAHPMAEWVLETYYADRFNQTERGSRSVYVFEQPESRITPLMEHIEQTYPGVRSYSLPSVGWTHSDGTQVKPHIEFGIKAEGEAVNLLDAAWAEVLHSLDGLGAELKNRVN

SEQ ID NO: 8345 - protein, 447 aa, Neisseria meningitidis
MSQNHTILQSLPVGQKVGIAFSGGLDTSAALLWMKLKGALPYAYTANLGQPDEDDYNAIPKKAMEYGAENARLIDCRAQLAHEGIAAIQCGAFHVSTGGIAYFNTTPLGRAVTGTMLVSAMKEDDVNIWGDGSTYKGNDIERFYRYGLLTNPALKIYKPWLDQQFIDELGGRHEMSEFLIANGFNYKMSVEKAYSTDSNMLGATHEAKDLEFLNSGIKIVKPIMGVAFWDENVEVSPEEVSVRFEEGVPVALNGKEYADPVELFLEANRIGGRHGLGMSDQIENRIIEAKSRGIYEAPGMALFHIAYERLVTGIHNEDTIEQYRINGLRLGRLLYQGRWFDSQALMLRETAQRWVAKAVTGEVTLELRRGNDYSILNTESPNLTYQPERLSMEKVEDAAFTPLDRIGQLTMRNLDITDTRVKLGIYSQSGLLSLGEGSVLPQLGNKQ

SEQ ID NO: 8346 - protein, 80 aa, Neisseria meningitidis
MIPYVKRNPMKEYKVIIYQESLLSSLFFGAAKVNPIKFSEFLNKQTPEGWRVVTMEKDLRRMLLFFKREAYVVILERDRV

SEQ ID NO: 8347 - protein, 71 aa, Neisseria meningitidis
MFKLGVYTCLGLFAGWVLLLIVQLWFSFLEAELFFKITLTMAGLFVIILAALLVCGQYFSEKKMKDDGFIN

SEQ ID NO: 8348 - protein, 488 aa, Neisseria meningitidis; identical to SEQ ID NO: 2184

SEQ ID NO: 8349 - protein, 409 aa, Neisseria meningitidis
MAFGKSLFHAIGRVSLVRQIAAGLALGIVIGSVSPQLGLAAGLFGSLFVGALKAVAPVLVFILVAATIAQHQKGNKAHIRPIIVLYLIGTFSAALTAVIAGMVFPTHIVLAGAGDVSAAPPSGIVEVLKSLLMNLVANPINAIANANYIGILAWALVLGAALRNHGSDVTRQVVADLAEAVSTVVKWIIRFAPLGIFGLVSSTIAETGFGALAGYAKLLAVLLGCMAFIALAVNPAIVWWKIRRNPFPLVFTCLRESGVYAFFTRSSAANIPVNMALAKKLGLHEDTYSISIPLGATINMAGAAITITVLAMAAAHTQGITVDFATALLLSLVATVSACGASGVAGGSLLLIPLACSLFGIDNDVAMQVVAVGFIIGVIQDSAETALNSSTDVLFTAAADLGRQRNRAE

SEQ ID NO: 8350 - protein, 635 aa, Neisseria meningitidis
MPSEASRPVRTVLKSKAATPMHDTRTMMIKPTALLLPALFFFPHAYAPAADLSENKAAGFALFKNKSPDTESVKLKPKFPVLIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKAYPLAKLGNTQAAVNPDTATADLNVVVDSGRPIAFGDFEITGTQRYPEQIVSGLARFQPGMPYDLDLLLDFQQALEQNGHYSGASVQADFDRLQGDRVPVKVSVTEVKRHKLETGIRLDSEYGLGGKIAYDYYNLFNKGYIGSVVWDMDKYETTLAAGISQPRNYRGNYWTSNVSYNRSTTQNLEKRAFSGGVWYVRDRAGIDARLGAEFLAEGRKIPGSAVDLGNSHATMLTASWKRQLLNNVLHPENGHYLDGKIGTTLGTFLSSTALIRTSARAGYFFTPENKKLGTFIIRGQAGYTVARDNADVPSGLMFRSGGASSVRGYELDSIGLAGPNGSVLPERALLVGSLEYQLPFTRTLSGAVFHDMGDAAANFKRMKLKHGSGLGVRWFSPLAPFSFDIAYGHSDKKIRWHISLGTRF

SEQ ID NO: 8351 - protein, 1405 aa, Neisseria meningitidis
MATSDGIAANHFETDIMTDTAPTDTDPTENGTRKMPSEHRPTPPAKKRRPLLKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGAASVGLKKPFALDTAIYTKGGLEGKTIHSTARLSGSLKDVRAELAIDGGNIRLSGKSVIHPFAESLDKTLEEVLVKGFNINPAAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAAVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLGIANAFGGNMANAPLGGRITASLPDLGALKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNGKGK

SEQ ID NO: 8352 - protein, 485 aa, Neisseria meningitidis
MSRHPAPTGEKTFFGHPFQLSTLFHIELWERFSFYGMQGILLIYLYYTADKGGLGIDKTLAGGIVGAYSGSVYLSTILGAWFADRVWGAEKTLFLSGIVVMLGHIVLAAAPGLYGLLIGLIFIALGSGGVKSTASSMVGALYEQDEMRPLRDAGFSIFYIAINIGGFLGPLLTGLLQENIGFHYGFGAAAVGMAFGLWRYSLGRKNLPHPTVPHPLSKGQGKTAAAVGIALIAALATAIKTGLVNLDNFSGILLSTVILAVIAYFARLLTNPRVSSDNKRHIIAYIPLFLTICMFWAVWFQIYTVATVYFDETVNRTIGSFTVPVAWKDSMQSLWVILFSGLMAAMWTKMGRKQPKTPLKFAMAVFVTGASFLGFVPFISSGTPMPIAVFALIVLAITIGELMISPIALSISTKIAPPLFKTQMVALNFLAFSLGFTLGGVLFEKGYQAGDEIGFYRLLFYIGAATGFLLLLLVPKLNKMLEGTD

SEQ ID NO: 8353 - protein, 70 aa, Neisseria meningitidis
MLKQPTRTLGGQRHCVLFGLAPNGVWPAAYCYQMRGAPLPHLFTLTCAAKAAIGGFAFCSTFRRVTAPGR

SEQ ID NO: 8354 - protein, 367 aa, Neisseria meningitidis
MEAEVINQLNNTLNDLEKRSEDIRVYMDYQGKKDRLEEVIGLSEDPELWNDPKRAQEIGKERKILEGIVLTLDNIASGIEDNRMLIEMTVEENDEEGFAAVQEDVAGLEKQMADLEFKRMFNQPADPNNCFIDITAGAGGTEAEDWAGMLFRMYSRYAERKGFRIEILEEDDGEIAGINRATIRVEGEYAYGLLRTETGVHRLVRYSPFDSNNKRHTSFASVFVYPEIDDSIEIEINPADLRIDTYRASGAGGQHINKTDSAVRITHEPTGIVVQCQNDRSQHANKAAAMEMLKSKLYELEMRKRNEEKQALEEGKSDVGWGSQIRSYVLDSSRIKDLRTGYEVGNTKAVLDGDLDGFIEASLKQGV

SEQ ID NO: 8355 - protein, 297 aa, Neisseria meningitidis
MVTFSKIRPLLAIAAAALLAACGTAGNNAVRKPVQTAKPAAVVGLALGGGASKGFAHVGIIKVLKENGIPVKVVTGTSAGSIVGSLFASGMSPDRLELEAEILGKTDLVDLTLSTSGFIKGEKLQNYINRKVGGRQIQQFPIKFAAVATDFETGKAVAFNQGNAGQAVRASAAIPNVFQPVIIGRHTYVDGGLSQPVPVSAARRQGANFVIAVDISARPGKNISQGFFSYLDQTLNVMSVSALQNELGQADVVIKPQVLDLGAVGGFDQKKRAIRLGEEAARAALPEIKRKLAAYRY

SEQ ID NO: 8356 - protein, 149 aa, Neisseria meningitidis
MKIGTTWQTASAMLVLRLFAAYEFLESGLQKWNGENWFSEINDQFPFPFNLLPDALNWNLAMYAELLLPVLLLLGLATRLSALGLMVVTAVAWAAVHAGSGYNVCDNGYKMALIYIVVLIPLLFQGAGGWSLDTLLKKRFCPRCRLKQD

SEQ ID NO: 8357 - protein, 102 aa, Neisseria meningitidis; identical to SEQ ID NO: 3392

SEQ ID NO: 8358 - protein, 288 aa, Neisseria meningitidis
MPSEPGKNMIQHAGLGYRRDLAEDFLSLSENSPICFIEAAPENWLKMGGWARKQFDRVAERLPLALHGLSMSLGGQAPLDTDLIDGIKEMMRRYDCTFFSDHLSYCHDGGHLYDLLPLPFTEEMVHHTARRIREVQDRLGCRIAVENTSYYLHSPLAEMNEVEFLNAVAREADCGIHLDVNNIYVNAVNHGLLSPEAFLENVDAERVCYIHIAGHDVETPELLIDTHGAAVLPTVWDLLELAYAKLPTIPPTLLERDFNFPPFSELEAEVAKIADYQTRAGKECRRAA

SEQ ID NO: 8359 - protein, 248 aa, Neisseria meningitidis
MQPETSAQYQHRFAQAIRGGEAADGLPQDRLNVYIRLIRNNIYSFIDRCYTETLQYFDREEWGRLKEGFVRDACAQTPYFQEIPGEFLQYCQSLPLLDGILALMDFEYTQLLAEVAQIPDIPDIHYSNDSKYTPSPAAFIRQYRYDVTDDLHEAETALLIWRNAEDDVMYQTLDGFDMMLLEIMGFSALSFDTLAQTLVEFMPEDDNWKNILLGKWSGWTEQRIIIPSLSAISENMEDNSPGQNHLSA

SEQ ID NO: 8360 - protein, 195 aa, Neisseria meningitidis
MPLPDLTDAELIESRKLLLHFARLQLPDHPDLAEDLVQETLLSAYSAGDSFQGRALVNSWLFAILKNKIIDALRQIGRQRKVFTTLDDELLDEAFESHFSQNGHWTQEGQPQHWNTPEKSLNNNEFQKILQSCLYNLPENTARVFTLKEILGFSSDEIQQMCGISTSNYHTIMHRARESLRQCLQIKWFNQENPK

SEQ ID NO: 8361 - protein, 59 aa, Neisseria meningitidis
MKKCRDIALLLSKHQDRETTPGEKISIYTHLLFCPYCREYKRQLQTIKRSLAKTTRTSK

SEQ ID NO: 8362 - protein, 36 aa, Neisseria meningitidis
MYKYAKYEGCINLPYLLYLPYFTDGATPPAQPVLSE

SEQ ID NO: 8363 - protein, 140 aa, Neisseria meningitidis
MRPIFLSFVLFPILITACSTPDKSARWENIGTISNGNIHTYINKDSVRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 8364 - protein, 321 aa, Neisseria meningitidis; identical to SEQ ID NO: 6441

SEQ ID NO: 8365 - protein, 86 aa, Neisseria meningitidis
MRQISLTDYFCKGLYLFDIFEDIVFLGKRLFTVRKFLDFSELLEMVNTQGYFLEFLYLYSGLNLNQYGVASPCRTICTVCGFVALS

SEQ ID NO: 8366 - protein, 189 aa, Neisseria meningitidis
MLFPRIIAASAQRKLSVYLKKGGLVAYPTESCYGLGCLPTLAKALGKLAHLKKRPQHKGMIVIGNQFEQLQPLLQMPSENLQDMLRKEWPAPKTFLLSAKSCVLPELRGKQRSKLAVRVPAHVGARRLCQALQTPLVSTSCNRAGKRACRTEREVRRQFGRDVWIVGGRIGRQKSPSQIIDGETGKRLR

SEQ ID NO: 8367 - protein, 423 aa, Neisseria meningitidis
MKLLVIGNGGREHALAWKLAQSPKVETVFVAPGNAGTAIEPKLQNIDLTAHQDLIEFCRKENIVFTVVGPEAPLAAGIVDDFRAAGLKIFGPTQYAAQLESSKDFAKAFMAKYNIPTAQYQTFENADAAHDYVNQKGAPIVIKADGLAAGKGVIVAMTLDEAHAAIDDMLLDNKMGNAGARVVIEDFLQGEEASFIVMVDGNNVLPMATSQDHKRLLDGDKGLNTGGMGAYSPAPVVTPVVYERAMNEIILPTVAGMKAEGHEFTGFLYAGLMIDQSGAPYTIEFNCRFGDPETQPIMSRLNSDLSDLVEAAIDGKLDSVTAEWSPQTAVGVVLAAQNYPETPKKGDIISGLDAANQIGKVFHAGTTANEKGDVLTNGGRVLCVVGLGDNVAQAKAKAYGALEKISFDGMQYRKDIADKAINR

SEQ ID NO: 8368 - protein, 105 aa, Neisseria meningitidis
MQKRIDEIQSKYREWCHLLPQLEEDIRRWKHVVTLIRDMDNFYTHEYQACHQAIEDGVELDLSTEGEYSIMSEDALWNALGEFHQLAWLYLRSSVDALDKYTQED

SEQ ID NO: 8369 - protein, 203 aa, Neisseria meningitidis
MITTYKTITSLTQAEFKDKGSRFIAFAYPIRTLADVKKYLDPLKEEHHKARHWCYAYRLGVDGVQFRANDDGEPSGSAGRPILGQIDSVGITDVLVVVVRYFGGTLLGVPGLIHAYKEATAQALAVAEVVEKNIEKTVWLKCEYPFLNEAIRIAKQYQADILERDLQLDCRLTVSLSLVNYEACVAAWKNTRQIEVNTEKPFE

SEQ ID NO: 8370 - protein, 311 aa, Neisseria meningitidis
MSVLIIVEHDNKQLNPTTLHAVTAAAKLGKVDLLVAGNGASAVVEFAKQVAGVKKVLVADAAHYAEGLAEELAPLVVKLAADYRYVAATATTFGKNLLPRVAALLDVPQISDLTEIVDNTTFVRPIYAGNAFETVQADSEKLVLTFRATVFDAVAAQGGNAEVINVEATPAQNLSRFVNRQLSHSDRPELTQAKVIVSGGRALGSAEKFNEVLTPLADVLGAAIGASRAAVDAEYAPNDAQVGQTGKVVAPQLYFAIGISGAIQHVAGMQDSKVIVAINKDADAPIFNVADYGLVGDLFEIVPQLTEVLKN

SEQ ID NO: 8371 - protein, 249 aa, Neisseria meningitidis
MKALVAVKRVVDYNVKVRVKADGSDVDIGNVKMSMNPFDEIAVEEAVRLKEAGKVSEIVAVSLGEKKCEETLRTALAMGADRAIHVETDTKLESLAVAKLLKAVADKENPQIFFLGKQAIDDDANQVAQMLAALLNAAQGTFASKVQIEGDEVQIVREIDGGEETIALKLPAVISADLRLNEPRFVKLPNIMAAKKKPLEKLTPDDLVADISPRLKTVKFAEPKARQAGVKVASVAELVEKLKNEAKVI

SEQ ID NO: 8372 - protein, 322 aa, Neisseria meningitidis
MKILLVRLSSMGDLIHTLPAIEDLARQCPDVELHWLCEAGFADIARLHPFVKKIHVMKWRQWRKHLFRAETWREMGHLKQTLRQEVFDFVLDSQGLIKSACFAKMAKSPICGLDKNSAREGWAALAYVKTYAVPKGKNAVWRNRELFAQVFGYVMPETQVFGLTVPEAGRLKNLAQPYYAALHATSRDSKLWPVENWRSLLQKLNEEQQCNIYLPWGNEDEKTRAKQIADGLPFAIVCDKINLLQAAYLLKYAVGIVGVDTGLLHLANALEKPVVGIYTDTDPIKTGVQVSPIAKNLGNIGQIPTADLVYQALMDCVAADKG

SEQ ID NO: 8373 - protein, 211 aa, Neisseria meningitidis
MIVSIDVDAQKTFTPLCPDELPVNEGHLIVEELNAQAALADLRVMTKDAHHMVAKWLVDNPVDMLKPTGLPDADLTWVAHAMVGTRGYELLDGLPSAKEYDYCVWKGVDPELHPYGACFHDIEEKLSTGLIEWLRCQNTDTVIIGGLATDYCVKTTVLQLLKGGRWQVVVNEAACRGIAPETIETAWQEMHSAGAIILKNADEINKYINNQ

SEQ ID NO: 8374 - protein, 226 aa, Neisseria meningitidis
MTYTITPIGTARSPYKQKFGIARQPGLVSAAKACIELNPKFTADSVRGLEDFDYVWISFIFHGVLDEGWAQMVRPPRLGGKQKMGVFATRSPHRPNHLGLSLLKLERIETGKPVRLYCSGADLLDGTPIVDIKPYIPFVESKPDAASGFVSGKPVELEVVWQENIGAENLSANTKNLISQSIAQDPRPAYQNIPERIYVMNIADYEVRFQIEENRATVIDLSPTPL

SEQ ID NO: 8375 - protein, 334 aa, Neisseria meningitidis
MSIKVAINGFGRIGRLALRQIEKAHDIEVVAVNDLTPAEMLLHLFKYDSTQGRFQGTAELKDDAIVVNGKEIKVFANPNPEELPWGELGVDVILECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVASGSLTELVSILERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 8376 - protein, 864 aa, Neisseria meningitidis
MSKSAVSPMMQQYLGIKAQHTDKLVFYRMGDFYEMFFDDAVEAAKLLDITLTTRGQVDGEPVKMAGVPFHAAEQYLARLVKLGKSVAICEQVGEVGAGKGPVERKVVRIVTPGTLTDSALLEDKETNRIVAVSPDKKYIGLAWASLQSGEFKTKLTTVDKLDDELARLQAAEILLPDSKNAPQLQTASGVTRLNAWQFAADAGEKLLTEYFGCQDLRGFGLDGKEHAVAIGAAGALLNYIRLTQNLMPQHLDGLSLETDSQYIGMDAATRRNLEITQTLSGKKSPTLMSTLDLCATHMGSRLLALWLHHPLRNRAHIRARQEAVAALESQYKPLQCRLKSIADIERIAARIAVGNARPRDLAALRDSLFALSEIELSAECSSLLGTLKAVFPENLSTAEQLRQAILPEPSVWLKDGNVINHGFHPELDELRRIQNHGDEFLLDLEAKERERTGLSTLKVEFNRVHGFYIELSKTQAEQAPADYQRRQTLKNAERFITPELKAFEDKVLTAQEQALALEKQLFDGVLKNLQTALPQLQKAAKAAAALDVLSTFSALAKERNFVRPEFADYPVIHIENGRHPVVEQQVRHFTANHTDLDHKHRLMLLTGPNMGGKSTYMRQVALIVLLAHTGCFVPADAATIGPIDQIFTRIGASDDLASNRSTFMVEMSETAYILHHATEQSLVLMDEVGRGTSTFDGLALAHAVAEHLLQKNKSFSLFATHYFELTYLPEAHTAAVNMHLSALEQGQDIVFLHQIQPGPAGKSYGIAVAKLAGLPVRALKSAQKHLNGLENQAAANRPQLDIFSTMPSEKGDEPNVGNFVDKAEEKHFEGILAAALEKLDPDSLTPREALSELYRLKDLCKSVS

SEQ ID NO: 8377 - DNA, 33 bp, Neisseria meningitidis
cgcggatcccatatgtttatgaacaaattttcc

SEQ ID NO: 8378 - DNA, 29 bp, Neisseria meningitidis
cccgctcgagtttgctttcgatagaacgg

SEQ ID NO: 8379 - DNA, 30 bp, Neisseria meningitidis
cgcggatcccatatggccggcgtgctgatg

SEQ ID NO: 8380 - DNA, 29 bp, Neisseria meningitidis
cccgctcgagttcatctttttcatgttcg

SEQ ID NO: 8381 - DNA, 28 bp, Neisseria meningitidis
cgcggatcccatatgccgaccgtccgtt

SEQ ID NO: 8382 - DNA, 28 bp, Neisseria meningitidis
cccgctcgagtaaacgaatgccgtccag

SEQ ID NO: 8383 - DNA, 31 bp, Neisseria meningitidis
cgcggatcccatatggaatcaacactttcac

SEQ ID NO: 8384 - DNA, 27 bp, Neisseria meningitidis
cccgctcgagcacgcggttgctgtaac

SEQ ID NO: 8385 - DNA, 35 bp, Neisseria meningitidis
ccggaattctacatatgtttcagaaacatttgcag

SEQ ID NO: 8386 - DNA, 30 bp, Neisseria meningitidis
cccgctcgagtttgtttttccaagacagag

SEQ ID NO: 8387 - DNA, 32 bp, Neisseria meningitidis
cgcggatccgctagcggacacacttatttcgg

SEQ ID NO: 8388 - DNA, 26 bp, Neisseria meningitidis
cccgctcgagcagcgcgtcaaggctt

SEQ ID NO: 8389 - DNA, 32 bp, Neisseria meningitidis
cgcggatccgctagcgagttccgcctgcataa

SEQ ID NO: 8390 - DNA, 27 bp, Neisseria meningitidis
cccgctcgagccagcggtagcctaatt

SEQ ID NO: 8391 - DNA, 30 bp, Neisseria meningitidis
cgcggatccgctagcaggggcgacgacgtg

SEQ ID NO: 8392 - DNA, 28 bp, Neisseria meningitidis
cccgctcgagaaacagccatttgagcga

SEQ ID NO: 8393 - DNA, 34 bp, Neisseria meningitidis
cgcggatcccatatgtatttgaaacagctccaag

SEQ ID NO: 8394 - DNA, 26 bp, Neisseria meningitidis
cccgctcgagttctgggtgaatgtta

SEQ ID NO: 8395 - DNA, 34 bp, Neisseria meningitidis
cgcggatcccatatgtcagatttggcaaacgatc

SEQ ID NO: 8396 - DNA, 29 bp, Neisseria meningitidis
cccgctcgagcgtatcatatttcacgtgc

SEQ ID NO: 8397 - DNA, 34 bp, Neisseria meningitidis
cgcggatccgctagcacggttttgaagctttcgc

SEQ ID NO: 8398 - DNA, 27 bp, Neisseria meningitidis
cccgctcgagaatgacgaggttgtccg

SEQ ID NO: 8399 - DNA, 31 bp, Neisseria meningitidis
cgcggatcccatatgtgcggcacactgaccg

SEQ ID NO: 8400 - DNA, 24 bp, Neisseria meningitidis
cccgctcgaggccgcctttgcggc

SEQ ID NO: 8401 - DNA, 32 bp, Neisseria meningitidis
cgcggatcccatatgtcgggcatttacaccgg

SEQ ID NO: 8402 - DNA, 28 bp, Neisseria meningitidis
cccgctcgagttcgtcgaaaacctttgc

SEQ ID NO: 8403 - DNA, 35 bp, Neisseria meningitidis
cgcggatcccatatgaataaaggtttacatcgcat

SEQ ID NO: 8404 - DNA, 26 bp, Neisseria meningitidis
cccgctcgagaatcgctgcaccggct

SEQ ID NO: 8405 - DNA, 30 bp, Neisseria meningitidis
cgcggatcccatatgactgccttttcgaca

SEQ ID NO: 8406 - DNA, 26 bp, Neisseria meningitidis
cccgctcgaggcgtgaagcgtcagga

SEQ ID NO: 8407 - DNA, 29 bp, Neisseria meningitidis
cgcggatcccatatgtgccggctggcggg

SEQ ID NO: 8408 - DNA, 25 bp, Neisseria meningitidis
cccgctcgagccagcggacgcgttc

SEQ ID NO: 8409 - DNA, 31 bp, Neisseria meningitidis
cgcggatccgctagcgacggcgcacaaccga

SEQ ID NO: 8410 - DNA, 26 bp, Neisseria meningitidis
cccgctcgagtgtttggcggatgggg

SEQ ID NO: 8411 - DNA, 34 bp, Neisseria meningitidis
cgcggatcccatatgattaaaatcaaaaaaggtc

SEQ ID NO: 8412 - DNA, 27 bp, Neisseria meningitidis
cccgctcgaggccttccttctcaatgg

SEQ ID NO: 8413 - DNA, 33 bp, Neisseria meningitidis
cgcggatcccatatgaaagaagcggggtttgaa

SEQ ID NO: 8414 - DNA, 28 bp, Neisseria meningitidis
cccgctcgagtctcaaagcttccagcag

SEQ ID NO: 8415 - DNA, 33 bp, Neisseria meningitidis
cgcggatcccatatgaaaaccttcttcaaaacc

SEQ ID NO: 8416 - DNA, 28 bp, Neisseria meningitidis
cccgctcgagttatttggctgcgccttc

SEQ ID NO: 8417 - protein, 9 aa, Neisseria meningitidis
SSSLGSAKG

SEQ ID NO: 8418 - protein, 12 aa, Neisseria meningitidis
NYKAPSTDFKLY

SEQ ID NO: 8419 - protein, 16 aa, Neisseria meningitidis
NRASVDLGGSDSFSQT

SEQ ID NO: 8420 - protein, 15 aa, Neisseria meningitidis
NYIGKVNTVKNVRSG

SEQ ID NO: 8421 - protein, 174 aa, Neisseria meningitidis; identical to SEQ ID NO: 4009

SEQ ID NO: 8422 - protein, 174 aa, Neisseria meningitidis
MKKALATLIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSIGLGVLTGVSYAVTPNVDLDAGYRYNYIGKVNTVKNVRSGELSVAVRVKF

SEQ ID NO: 8423 - protein, 174 aa, Neisseria meningitidis
MKKALAALIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSITLGVLTAVSYAVTPNVDLDAGYRYNYIGKVNTVKNVRSGELSVGVRVKF

SEQ ID NO: 8424 - protein, 174 aa, Neisseria meningitidis
MKKALATLIALAIPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSITLGVLTGVSYAVTPNVDLDAGYRYNYIGKVNTVKNVRSGELSVAVRVKF

SEQ ID NO: 8425 - protein, 174 aa, Neisseria meningitidis
MKKALATLIALAIPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSITLGVLTAVSYAVTPNVDLDAGYRYNYIGKVNTVKNVRSGELSVGVRVKF

SEQ ID NO: 8426 - protein, 174 aa, Neisseria meningitidis
MKKALATLIALAIPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSITLGVLTAVSYAVTPNVDLDAGYRYNYIGKVNTVKNVRSGELSVAVRVKF

SEQ ID NO: 8427 - protein, 173 aa, Neisseria meningitidis
MKKALAALIALALPAAALAEGASGFYVQADAAHAKASSLGSAKGFSPRISAGYRINDLRFAVDYTRYKNYKQPSTDFKLYSIGASAVYDFDTQSPVKPYLFARLSLNRASVAHGGSDSFSQKSIALGVLTAVSYAVTPNVDLDAGYRYNYIVKVNTVKNVRSGELSVAVRVKF

SEQ ID NO: 8428 - protein, 174 aa, Neisseria gonorrhoeae
MKKALAALIALALPAAALAEGASGFYVQADAAHAKASSSLGSAKGFSPRISAGYRINDLRFAVDYTRYKNYKAPSTDFKLYSIGASAVYDFDTQSPVKPYLFARLSLNRASVAHGGSDSFSQKSIALGVLTAVSYAVTPNVDLDAGYRYNYIVKVNTVKNVRSGELSVAVRVKF

SEQ ID NO: 8429 - protein, 174 aa, Neisseria gonorrhoeae
MKKALAALIALALPAAALAEGASGFYVQADAAHAKASSSLGSAKGFSPRISAGYRINDLRFAVDYTRYKNYKQPSTDFKLYSIGASAVYDFDTQSPVKPYLFARLSLNRASVAHGGSDSFSQKSIALGVLTAVSYAVTPNVDLDAGYRYNYIVKVNTVKNVRSGELSVAVRVKF

SEQ ID NO: 8430 - protein, 33 aa, Unknown
  Synthetic construct
CGCGGATCCCATATGTTTATGAACAAATTTTCC

SEQ ID NO: 8431 - protein, 29 aa, Unknown
  Synthetic construct
CCCGCTCGAGTTTGCTTTCGATAGAACGG

SEQ ID NO: 8432 - protein, 30 aa, Unknown
  Synthetic construct
CGCGGATCCCATATGGCCGGCGTGCTGATG

SEQ ID NO: 8433 - protein, 29 aa, Unknown
  Synthetic construct
CCCGCTCGAGTTCATCTTTTTCATGTTCG

SEQ ID NO: 8434 - protein, 28 aa, Unknown
  Synthetic construct
CGCGGATCCCATATGCCGACCGTCCGTT

SEQ ID NO: 8435 - protein, 28 aa, Unknown
  Synthetic construct
CCCGCTCGAGTAAACGAATGCCGTCCAG

SEQ ID NO: 8436 - protein, 31 aa, Unknown
  Synthetic construct
CGCGGATCCCATATGGAATCAACACTTTCAC

SEQ ID NO: 8437 - protein, 27 aa, Unknown
  Synthetic construct
CCCGCTCGAGCACGCGGTTGCTGTAAC

SEQ ID NO: 8438 - protein, 35 aa, Unknown
  Synthetic construct
CCGGAATTCTACATATGTTTCAGAAACATTTGCAG

SEQ ID NO: 8439 - protein, 30 aa, Unknown
  Synthetic construct
CCCGCTCGAGTTTGTTTTTCCAAGACAGAG

SEQ ID NO: 8440 - protein, 32 aa, Unknown
  Synthetic construct
CGCGGATCCGCTAGCGGACACACTTATTTCGG

SEQ ID NO: 8441 - protein, 26 aa, Unknown
  Synthetic construct
CCCGCTCGAGCAGCGCGTCAAGGCTT

SEQ ID NO: 8442 - protein, 32 aa, Unknown
  Synthetic construct
CGCGGATCCGCTAGCGAGTTCCGCCTGCATAA

SEQ ID NO: 8443 - protein, 27 aa, Unknown
  Synthetic construct
CCCGCTCGAGCCAGCGGTAGCCTAATT

SEQ ID NO: 8444 - protein, 30 aa, Unknown
  Synthetic construct
CGCGGATCCGCTAGCAGGGGCGACGACGTG

SEQ ID NO: 8445 - protein, 28 aa, Unknown
  Synthetic construct
CCCGCTCGAGAAACAGCCATTTGAGCGA

SEQ ID NO: 8446 - protein, 34 aa, Unknown
  Synthetic construct
CGCGGATCCCATATGTATTTGAAACAGCTCCAAG

SEQ ID NO: 8447 - protein, 26 aa, Unknown
  Synthetic construct
CCCGCTCGAGTTCTGGGTGAATGTTA

SEQ ID NO: 8448 - protein, 34 aa, Unknown
  Synthetic construct
CGCGGATCCCATATGTCAGATTTGGCAAACGATC

SEQ ID NO: 8449 - protein, 29 aa, Unknown
  Synthetic construct
CCCGCTCGAGCGTATCATATTTCACGTGC

SEQ ID NO: 8450 - protein, 34 aa, Unknown
  Synthetic construct
CGCGGATCCGCTAGCACGGTTTTGAAGCTTTCGC

SEQ ID NO: 8451 - protein, 27 aa, Unknown
  Synthetic construct
CCCGCTCGAGAATGACGAGGTTGTCCG

SEQ ID NO: 8452 - protein, 31 aa, Unknown
  Synthetic construct
CGCGGATCCCATATGTGCGGCACACTGACCG

SEQ ID NO: 8453 - protein, 24 aa, Unknown
  Synthetic construct
CCCGCTCGAGGCCGCCTTTGCGGC

SEQ ID NO: 8454 - protein, 32 aa, Unknown
  Synthetic construct
CGCGGATCCCATATGTCGGGCATTTACACCGG

SEQ ID NO: 8455 - protein, 28 aa, Unknown
  Synthetic construct
CCCGCTCGAGTTCGTCGAAAACCTTTGC

SEQ ID NO: 8456 - protein, 35 aa, Unknown
  Synthetic construct
CGCGGATCCCATATGAATAAAGGTTTACATCGCAT

SEQ ID NO: 8457 - protein, 26 aa, Unknown
  Synthetic construct
CCCGCTCGAGAATCGCTGCACCGGCT

SEQ ID NO: 8458 - protein, 30 aa, Unknown
  Synthetic construct
CGCGGATCCCATATGACTGCCTTTTCGACA

SEQ ID NO: 8459 - protein, 26 aa, Unknown
  Synthetic construct
CCCGCTCGAGGCGTGAAGCGTCAGGA

SEQ ID NO: 8460 - protein, 29 aa, Unknown
  Synthetic construct
CGCGGATCCCATATGTGCCGGCTGGCGGG

SEQ ID NO: 8461 - protein, 25 aa, Unknown
  Synthetic construct
CCCGCTCGAGCCAGCGGACGCGTTC

SEQ ID NO: 8462 - protein, 31 aa, Unknown
  Synthetic construct
CGCGGATCCGCTAGCGACGGCGCACAACCGA

SEQ ID NO: 8463 - protein, 26 aa, Unknown
  Synthetic construct
CCCGCTCGAGTGTTTGGCGGATGGGG

SEQ ID NO: 8464 - protein, 34 aa, Unknown
  Synthetic construct
CGCGGATCCCATATGATTAAAATCAAAAAAGGTC

SEQ ID NO: 8465 - protein, 27 aa, Unknown
  Synthetic construct
CCCGCTCGAGGCCTTCCTTCTCAATGG

SEQ ID NO: 8466 - protein, 33 aa, Unknown
  Synthetic construct
CGCGGATCCCATATGAAAGAAGCGGGGTTTGAA

SEQ ID NO: 8467 - protein, 28 aa, Unknown
  Synthetic construct
CCCGCTCGAGTCTCAAAGCTTCCAGCAG

SEQ ID NO: 8468 - protein, 33 aa, Unknown
  Synthetic construct
CGCGGATCCCATATGAAAACCTTCTTCAAAACC

SEQ ID NO: 8469 - protein, 28 aa, Unknown
  Synthetic construct
CCCGCTCGAGTTATTTGGCTGCGCCTTC

SEQ ID NO: 8470 - protein, 9 aa, Neisseria meningitidis
SSSLGSAKG

SEQ ID NO: 8471 - protein, 12 aa, Neisseria meningitidis
NYKAPSTDFKLY

SEQ ID NO: 8472 - protein, 16 aa, Neisseria meningitidis
NRASVDLGGSDSFSQT

SEQ ID NO: 8473 - protein, 15 aa, Neisseria meningitidis
NYIGKVNTVKNVRSG
